United States Patent 8,283,114 (GENES OF AN OTITIS MEDIA ISOLATE OF NONTYPEABLE HAEMOPHILUS INFLUENZAE) - sequence listing, part 4

SEQ ID NO: 1913 - DNA, 972 bp, H. influenzae strain 86-028NP
atgaatcctttattagatgtaaaaaatctctacgttcgcttcaaaacaccagatggcgtcgttacagcagtgaatgacttaaacttcacgctgaatgcaggaagcacgctgggcattgtaggcgaaagtggatcaggcaagtcacaaacagcctttgctttaatgggtttattggcagccaacggtgaagtggaaggctctgccatttttgaagggaaagaattagttaatttaccgaatgctgaattgaataaaatccgcgccgagcaaatttccatgattttccaagatccaatgacgtcactcaacccatacatgaaaatcggtgaacaactcatggaagtgctgcaattgcacaagggctatgataaacaaactgcctttgccgaatccgtgaaaatgttagacgcagttaaaatgccagaagctaaaaaacgcatgggcatgtatccgcacgagttttctggcggtatgcgtcaacgggtgatgattgcgatggccctattatgccgtcccaaactactcattgcagatgaaccaacaaccgctttggatgtgaccgttcaagcacaaatcatgaccttgttaaatgagttaaaacacgaatttaatactgcgattattatgattacccatgatcttggggtagtggctggtatctgcgatcaagtcatggtgatgtatgctggacgaaccatggaatacggcacagcggaacaaattttctatcatccaacccatccctattccataggcttaatggatgcgattcctcgcttagacggcaatgaagaacacttggtcaccattcctggcaatccaccgaatttattgcatttgccaaaaggttgtccattctcacctcgttgccaatttgctaccgaacaatgccaaattgcgccaaaactgactacatttaatcacggtcaattacgtaattgttggttatcagcggagaaatttaacctatga

SEQ ID NO: 1914 - DNA, 936 bp, H. influenzae strain 86-028NP
atgacagattatcgtactcagccgattaatcagaaaaatgcggattttgtggaacaagtggctgaccgtattgaagaaatgcaactggaaggccgcagcctatggcaagatgcgaaacgccgttttttccgcaacaaagcggccgttgtcagtctgattattttggcgtttattattatatttatcaccgtagcgccttggttcttcccatttacctatgaagataccgattggaatatgatgagctccgcaccaacaatggaaggctatcacttcttcggtaccgatgcctcaggtcgagacttgttggtacgtactgctatcggtggacgtatttcattattggtcggtattgctggtgctttcatttccgtgactatcggcacaatttatggggctatttccggttatgtaggcggtaaaacagatatgctgatgatgcgctttttggaaattcttagctcatttccatttatgtttttcgtgattttgttggtgaccctttttggccaaaacattttcttaatttttatcgctatcggggccattgcctggcttggtcttgcacgtattgtacgcggacaaaccctcagcctaaaaaataaagaattcgtcgaagccgccatcgtttgtggcgtacctcgtcgccaaatcattttgaaacacattattccgaatgtattaggcttagtggcagtttatgcctcgcttgaagtgcctgggctcattctatttgaatcattcttaagcttcttaggattaggtacacaagagccgatgagtagttggggcgcactcttaagtgatggtgctgcacaaatggaagtgtcgccttggttattaattttcccggcatttttcctttgccttaccctattttgttttaactttatcggtgacgggttgcgtgatgcgctcgatccgaaagatagatag

SEQ ID NO: 1915 - DNA, 921 bp, H. influenzae strain 86-028NP
atgctcaagtttatttttaaacggctgttggaagccttaccgacgctgtttattttgattactttttctttctttttgatgcgtcttgcccctggcagccccttcacttctgaacgcgcttatccgccagaagtcatggctaatatcgaagcgaagtatcatttaaatgaaccattatataaacaatatttcctttatttagaaaatctttccaaaggagattttggtccctcttttaaatataaagaccaatcagtcaatgatttaatcgcgtcagctttccctgtttccataaaattgggaatggtggccttcgcctttgcagtcgtgctaggagtaacagcaggtacgctcgccgctctcaatcaaaatagccgttgggattatattttgatgagtttctcgatgcttggggtcattatgccaagcttcgtatttgcacctgttttagtgctaattttcgccatttatctaggatggctgccagctggcggttggaacggcggtaccgccatgtacatgatcttacctgtagcctccttaactatcgcttatgttgcagggattgcgcgtatcatgcgtggttcgatgattgaagtgttacattccaactttattcgaaccgccaaagctaaaggactttccatgtcgagaatcattttaaaacatgctttgcgtcccgcacttttacccgtgataacctatttaggacctgctttcgtagggattattactggctcaatggtcatcgaaagcgtatttggtttacctggcatggggttattatttgtaaacggcgcattgaaccgcgattactctttagttttgagcctcaccattttagtgggggcattaaccattttatttaatgcgattgtggatattttatacgccatcatcgatccaaaaattcgttattaa

SEQ ID NO: 1916 - DNA, 1626 bp, H. influenzae strain 86-028NP
atgcaacacaaactactcttctctgcaatcgctcttgctctttcctattctgtgcaagcagttatagtgcctgaaggaacacaattagatgaaaaacaacatatcgtcatcaataacggggctgaaccgcaaagttttgacccacacaaaaccgaaggtgtgccagaatctaacgttgcttatcaattacttgaaggcttagtcacctcagactctgaaggtaaacttcaaccgggtgcggctgaaagctgggaaaatacacctgacttcaaaacctggacattccatttacgtaaagatgctaaatggtcaaacggagatcctgttactgcacacgatttcgtgtttgcgtggcgtcgtttagtggatcctgcaactgctgcaccttatgcgagttacttaagttatttacaagttgaaaatgcgcaagacattattgacggtaagaaaaaaccggctgaattaggcgtggaagcaaaagatgattacacctttgtggttcatgcaaccaatcctgtgccttatgcagtcagtttaacgactcaccaatccttattgccattaccacaaaaagtagtcgaaaaattgggtgatgcatgggtgaaaaaagaaaactacgtgggtaacggtgcgtataagctggctaaccacatcattaacgaaaaaatcgaatttgaacgtaacccactttattggaacgataaagaaaccgtaatcaatagtgcgacattcctcgccattgaaaacccaagtaccgatgtagcacgttatcgtgcgggcgatttagacatgaccagttatggtttaccgccagaacaattcgctaaattaaaaaaagaattgctaggcgaagtatacgttactcgtaccctaggaacttattcttatgaattaaacaataagaaagcaccttttgataacgtgaatattcgtaaagccttgaacttatcccttgatcgtaatgtgatcaccgataaagtattgggccaaggtcaaacaccaacctatgtgtttaccccaacttacatcgaagaaggtcatctcattcaacaacctgcttattcaaaagaaccgatggcacaacgtaatgaagaagccattaaactcttagaagaagctggttacagtaaagcgaatccgttgaaattcagcattctttataataccaatgaaaaccacaaaaaagtggctattgctgcagcttctatgtggaaagctaacaccaaaggtttgattgatgtgaaattagaaaaccaagagtggaaaacttacattgatagccgtcgtgcaggtcgttacgatgtggcgcgtgctggatggcatgcggattacaaccaagcaacaacattcggcaactatttcttatctaattctagtaacaataccgcgaaatatgcgaatccagaatatgataaagcgatggcagaatcttacgcagcaactgatgcagaaggtcgtgcaaaagcttatgcgaaagccgaagaaattcttggaaaagattacggtatcgtaccaatctttaactatgtgaatccacgcttagtgaaaccttacgtaaaaggttattcaggcaaagatccacaagatcatatttacttacgcaatctttatattattaaacattaa

SEQ ID NO: 1917 - DNA, 954 bp, H. influenzae strain 86-028NP
atgacaacacagttagattcacttcgtaatatgaccgtcgtcgtagctgatactggcgatattgatgcaatcaaaaaataccaaccacaagatgcaacaacaaacccatctttaattttaagtgcttcagcattaccacaatacgccccattaattgatgaagcggttgcttatgcaaaagctcaaagcaatgataaagcacagcaacttattgatgcagaagataaattagcggtaaatattggtttagaaattttaaaaatcgttccagggcgtatttctactgaagtggatgcgcgtctttcttacaacacacaagcaacggttgaaaaagcgcgtaaattaatcgcactttataatgcagcaggcatctcaaatgatcgtattttgattaaaatcgcttccacatggcaaggtatccgagctgcagaaatccttgaaaaagaaggcattaactgtaacttaaccttattattctctgaagctcaagctcgtgcttgtgcagaagcaggcgtttacttaatttctccatttgtaggtcgtattttagactggtacaaagcaaactccgacaaaaaagaatatgcgccagcagaagatccaggcgttatttctgtcaccaaaatctacaattactacaaagaatatggctacaatacagttgtgatgggcgcaagtttccgtaatgtaggcgaaattactgaacttgcaggttgcgatcgcttaaccattgcaccagcattactgaaagaattacaagaaaattcaaccgcacttatacgcaaactagaatacaaaggcgaagtaaaagcgaaaccacaaccattaacagaagctgagttctactggcaacataacagcgatgctatggctgttgaaaaattagcagagggtattcgtaaatttgctattgaccaagaaaaattggaaaccatgctttcagcaaaactttaa

SEQ ID NO: 1918 - DNA, 1602 bp, H. influenzae strain 86-028NP
ttgaggagccttcctatgttatggtttttcttttgtgtagccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgttgcaatgctttggattgttattggttgtatttttgcgggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgcttcgcaaagtgcgttagtgcttggtgatgcagaggcagttcatcattctgttgaagctggtgggattaaagtatggggaatggataaagcaacagtggttgctctgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcgcgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttctccatctaaagttgtgtatgatagttcgttacatttcttaggttttattggtggtatttttgccatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactacagcgggatatttatatcgttatcataaattccactgggttgcgtctcttcctgcgtggtttatcacaacagtatgtgcaacttatttgttctacaacaaaattggtttcggcttagattatcagctttctgtgtatcttggtttagcaacaaccatcgtttgtatcgtattgttcttcacaatgcttaaaccattaggtacgcgagatgaagaagcttatataaataattag

SEQ ID NO: 1919 - DNA, 456 bp, H. influenzae strain 86-028NP
atgtttcgtggtgcaacggcggttaatttagattctaaggggcgtgtagcgatcccaactcgctatcgcgctgaaattcttgaaaagaaccaagggcaaatggtttgtactgtagatattcgccaatcctgtcttttactttatccccttgatgaatgggaaaaaatcgaacaaaaacttctcgcactttctaactttgatcctacccaacgccgtttgcagcgagtaatgcttggccatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcattatag

SEQ ID NO: 1920 - DNA, 966 bp, H. influenzae strain 86-028NP
atgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgtgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatagcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagcaaatcctcgttcaagaagtgccatattacgtgtggcagagagaatttag

SEQ ID NO: 1921 - DNA, 324 bp, H. influenzae strain 86-028NP
atgtctgaaaataataagcctcgttatccgttacagcagattttagtcgaagatttattttcttcaaataagttagtggtgttgctgttgatagggattttagtttctgcaatgggaacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaataa

SEQ ID NO: 1922 - DNA, 1833 bp, H. influenzae strain 86-028NP
atggtgaaatttaattcctcgcgtaaatcaggtaagtcaaaaaaaacaattagaaaattgaccgcacctgaaactgtaaagcaaaacaagtctcaaaaggtgtttgaaaaatgctttatgcgtggacgttatatgctttctacggttcttattttacttggtctgtgtgctttagtcgcacgagcagcttatgttcaatctattaatgccgatacgttatcaaatgaagcggataagcgttctttgcgtaaagatgaagtattatcggtgcgtggttctattttagatcgtaatggtcagcttttatctgtaagcgtaccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtattgatgaaaaattgcaatctatggtgtatcgtgagattaaaaaggcggtgtctgagaataatgcggagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtcgttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagcgcattaatggaaacttatcaaaatgcaggtttaagtaaaccgacagatttaggcttgatcggagaacaagttgggattttgaatgcaaatcgtaaacgctgggcagatattgagcgtgcaacagtcgcttatggttatggtattactgcgacacctttacaaattgctcgtgcctatgcaacccttggtagtttcggtgtttatcgcccgctttctatcactaaagttgatccgccagttattgggaaacgggttttctctgaaaaaataactaaagatattgtgggaattttagagaaagtagcaattaaaaataaacgcacaatggtggaaggctaccgtgtcggcgtaaaaacaggtacggcacgtaagattgaaaatggacattatgtaaataaatatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgaattgtttatattggcgaacacaagaatcaaaaagtgaattaa

SEQ ID NO: 1923 - DNA, 1467 bp, H. influenzae strain 86-028NP
atgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatctagcgagcatttaactgtggcgtttatcaggaatgtgccggtagttaaatattatcaacttgcacgtcatctttcgtccttagctgatgttttttatgattcgccctctaaaaatttaacccttgttggcgttacaggaacaaatggcaaaaccactatttctcaattattagcgcaatgggcggaattattggggcatcgtgcggctgtgatgggaaccattggtaatggacttttggggcaaattgtagaagctaaaaatacgacaggttcagcagtagaaattcagtcatctctttcaactttcaaacacgcaggtgcagattttacctctattgaagtttcatcacacggtttggcgcagcatcgtgtagaagccttgcattttaaagcggcaattttcacgaatttaacccgtgatcatctagattatcatcaatctatggaaaattatgctgcggcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaatcgttattgtagattatgcgcatacaccagatgcgttggaaaaagcgttgattgctgcgcgtgaacattgccaaggcgaattatggtgcatctttggttgtggcggagaccgtgatagaggcaaacgtccgttaatggcacaggttgcagagcagtttgctgaaaagattattgtgacaaaagataatccacgaacagaaccacaaagccaaattgaagcagatattgtcgctggctttaaaaatatggaaaaagtggggattattcctgatcgcgcacaggcgatccagtttgcgattgaaagtgcggtagaaaatgacgtgattttaattgctggaaagggtcacgagcattatcaaattattggttcggaagttgtgcatttttccgaccaagaaattgcacttgatttcttaaaataa

SEQ ID NO: 1924 - DNA, 1374 bp, H. influenzae strain 86-028NP
atgattaaactctctactgtacaacttgcacagattcttcaagctaaattaattggcgatgaaaatgtgcaagttgaagaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaactcgtctattttagttcctcaacttgtggttaaagacactcgtattgctttgggcgagcttgcaaaatggttacgcgagaaaattaatccgcgtactgtggcgatgaccggctcttctggaaaaaccacagtaaaagaaatgacagcaagtattttgcagcataccgcagcagattcagaagcggtactttttaccaatggtaacttcaataacgatataggtgtgcctttaactctgcttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggagttgttcaagcaaaaggcgagatttatcgaggtttaacaaaaaatggtgtggcgattatcaatgctgaacataatcacttagatatttggcaaaaagaaattagtaatcacgccattcaatatttcaacggcaaggactattccgtcaaaaatgttcaaggtaacgaacaaggttcaacctttacgttagtttctccgcaaggcgaaattgatattagtttaccttatcttggagagcataatgtaaaaaatgctttagctgctaccgcactagcgatgaatgttggtgctacgcttgccgatgtcaaagctggattagaacaacgttcacaagtgaaagggcgtttatttcctattcaagtaacgcctaatttattgttattagatgatacttataacgcaaataaagattctctctgtgcggctattgatgtcctaaaaagttatgatgctttccttattctatgtgtcgcagatatgaaagaattgggcgaaaattctctcgctattcatcgtgaagttggacaatatgttaatttggtaaatttagatttggtgtgttcttatggcaatgaaagtgcggttatttctgaggctgttttgggtaagcattttacggataaaactgaaatggtggatttcttagttccacttattgaaaaccaattacaacaaaataaaaaagttgtggtgctgggaaaaggctcacgctcaatgaaaatggaagatgtgatctattcattaaaggataaaattaaatgttag

SEQ ID NO: 1925 - DNA, 1083 bp, H. influenzae strain 86-028NP
atgttagtctggcttgctgaatatcttgttcgttacgaaaccgcctttaatgcgatttcttatattaccgtccgcgcaattcttgcattattaaccgcactttttatctcactttggattggccctaaagtgatcaaacgtttacagatcttaaaatttggtcaagaagtgcgaaatgatggccctgaaagtcactttgcaaaaaaaggcacacccactatgggcggtgtgatgattttattctctattggcgtaagtacgttattatgggcaaatcttgctaattcttatatttgggtttgtttatttgttttatttggatacggcgcaattggttttgtggatgatttccgtaaaattacccgtaaaaatactgatggattgattgcgcgttggaaatatttctggatgtctgtggtggcattagtggcaatcctttggctttattggcttggtcacgacactgatgccacccgtttagtgattccattctttaaagacattatgcctcagttaggtttgttctatattgtgttatcttactttgtgattgttggaaccggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttaggatttttatggtttaatacttatccagctcaagtatttatgggggacgtgggttctctagcattaggtggtgcgctgggtgtcgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgttagtgttgatgggattagtcaccttgaagttgcgttaa

SEQ ID NO: 1926 - DNA, 1314 bp, H. influenzae strain 86-028NP
atgaatgcctatcaaaacaaaaatattacgatcattgggcttggcaaaacaggtctttcttgtgtggattatctcttatcccaacaggctaatattcgtgtgattgatacccgaaaaaagcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggaaaaagtactgttactactttagtttatgaaatggcgaaagctgctggcgtgaaagttggtatgggcggaaatattgggattcccgctttgtcattgttgaatgaagattgtgaactttatgtactagagctttctagttttcagcttgagacaacttatagcttaaaagctgcggctgcgactgttttgaacgtgactgaagatcatatggatcgctatatggatttagaagattatcgccaagcaaaattacgcatttatcataatgctgaggtcggagttttgaataatgaggataagctgacttttggtgaaggtgaaaatcaagcgagacaaaccgtttcttttgcggaaaatagtgcggattattggctaaaaactgaaaatggcaagcaatacttaatggtaaaagatgaagtaattttgccttgtgaagaagtaacattagtcggtcgccataattatatgaacattttggcagcaacagcattggcacaagctgtcggtattaatttagattcaattcgtaccgcacttcgtcatttcaaagggttagatcatcgttttcaattagtgcatcaagctaatggtattcgttggattaatgactctaaagcaacaaatgtggggagtacagttgctgcattagctgggctttatattgagggtaaattgcatttgttgctaggcggagacggaaaaggggctgatttttcagaattagctgaattaattaatcaaccacacattatttgttattgttttggtcgagatggtgtgcagcttgcaaaattttcatcacaaagctatttgtttgaaacaatggaacaagcgatagaatttttacgcccaacattgcaaagcggagatatggtattattgtcgcctgcttgtgcaagtctcgatcagtttgcttcttttgaaaagcgcggcgaagaatttacgcatttagcgcaatattcagcctaa

SEQ ID NO: 1927 - DNA, 1185 bp, H. influenzae strain 86-028NP
atggaatttttacagaacatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctactttctttgctcacttgttatatttcattacaaatttcttcttcgcaatgggaaaaatggcacgctaaaatttttttattttctgtcatattattattgcttgtcccttttatcggtacatcggttaatggcgcaaaacgttggatttcattggggatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggatttttagaaccctttaaagatccttatggcactggtttccaattaacaaactctcttatagcatttgggcggggagaaattactggcgaaggattaggtaattcaattcaaaaattagattatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggattttctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgattag

SEQ ID NO: 1928 - DNA, 1056 bp, H. influenzae strain 86-028NP
atgaaaaataaaaaattattagtgatggcgggtggcactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgccgtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagcttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagtcgcagcaatttttgtaccattccaacataaagatcgccaacaatatttaaatgcgaaatatttatcagatgttgacgcggcgaaaattatagaacaggcagatttaacgcctgaaatgctagtgaattatttaaaaaatttaactcgtgaaaatttattgcagatggcattgaaagcgaaaacaatgtcgatgcctaatgcggcacaacgtgtagctgaagtaattaaacaatattcaaactag

SEQ ID NO: 1929 - DNA, 1428 bp, H. influenzae strain 86-028NP
atgaaacattcccacgaagaaattagaaaaattatccctgaaatgcgccgtgtacagcaaattcatttcattggcattggtggtgcgggaatgagcggcattgcagaaattttattaaatgaaggttatcaaatttcaggttcagatattgccgatggcgtagtcactcaacgtttagctcaagctggggcaaaaatctacattggtcatgcagaagaacatattaaaggtgccagtgttgttgttgtgtctagtgcgataaaagatgataaccctgaattagttgcatcgaaacaaaaacgcattccagtgattcaacgcgcacaaatgttggcggagattatgcgttttcgtcacggtattgctgttgcaggaacacacgggaaaacgacaacaacagcaatgatttcaatgatttacacccaagctaaacttgatccgacttttgtaaatggtggtttagtgaaatcggcgggtaagaatgcacatttaggggcaagtcgttatttaattgccgaagccgatgaaagtgatgcgtcgtttttgcatttacagccaatggtatctgttgtaactaatatggagccagaccatatggatacttacgaaggcgattttgaaaaaatgaaagccacttatgtgaaattcctgcataatttaccattctatggtttagccgtgatgtgcgctgatgatcctgttttaatggaacttgtgccaaaagttggtcgccaagtgattacatatggttttagtgagcaggcagattatcgcattgaagattatgaacaaacaggttttcaaggtcattacacagtgatttgcccaaataatgaacgtattaatgtgttgctcaatgttcctggaaaacataatgcattaaatgcaacggctgcacttgctgtagcaaaagaagagggtattgctaacgaggcaattttagaggctctggctgattttcagggggctggtcgtcgttttgatcagctaggcgaatttattcgtccaaatggtaaagtgcgtttagttgatgattatggtcatcatccaacagaagtagacgtaaccattaaagcagcgcgagaaggctggggagataaacgtattgtaatgattttccaaccgcatcgttattcgcgcactcgtgatttgtttgatgattttgtacaagtgctttcgctagtagacgctttgattatgcttgatgtgtacgcagcgggagaagcccctattgttggcgctgacagtaaatctctttgccgttccattcgtaatcttggtaaagttgatcctattttggtatcagatacttcgcaactaggcgatgttctcgatcaaattattcaagatggcgatttgattttggcacaaggtgctggtagcgtaagtaaaatttctcgtggcttggctgaatcttggaagaattaa

SEQ ID NO: 1930 - DNA, 921 bp, H. influenzae strain 86-028NP
atgaacttaaaacaagaaaaaatcgcggtgttattaggcggcacatctgctgaacgtgaagtttctttcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacggggtgtggcgtgatggcttctgcattaacgatggacaaaatgcgtacaaaaatgttgtggaaagcttttggtttacctgttgcagatatgaaagtggttacccgagaaactttttctgaattagatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagagttagcaatattagtaaaacgtgcttatgatgcactgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagttgagcctgtaa

SEQ ID NO: 1931 - DNA, 765 bp, H. influenzae strain 86-028NP
atgaacattctgaaaagaaaaacgccacagaatattcgttttggagaacaaaagcctaaatattattttcatattcgggcttttgcggtattgcttggtgtcttttttttacttggtgtttattttaattggcaaagcattttagaaaaaatggatgataagccgattagtgcatttgcacttgttggacaaaatacctttactactgctgatgatattaaagaaagcctattaaaaatgggcgaattaaaaggattttgggggcaagatgtggcaccgattcaagagcaaattgaggctttaccttgggttaaaggtgcaatcgtaagaaaaatgtggccaaatcgtttaagtatttgggtatcagaatatcaacctgttgcgttttggaatcaaaatcaatttgttacccttgatggtatcgtttttcagcttccctctgtacgtttaactgcaaaaaatttgccctatttgggcgggcccgattatcagagtttgaaagtaattgagacgtggaaccaaatttatattaatttaaaatcaaataatataatggcaaagggaattaatattgatgatcgcggtgcgtggcagatccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataa

SEQ ID NO: 1932 - DNA, 1278 bp, H. influenzae strain 86-028NP
atggttaaaggtgtggaaacaaaaacaatagtaggtttagaggttggcacgtcaaaagtggtcgctgtagttggcgaagtatttcctgatggtgtagtgaatgtgcttggtgtaggcagttgtccttcaaaagggattgatcgtggcagcatcactgatcttgatgccgtagtgggttcgattcaacgtgctattgaagcggcagaatctatggctgattgtcagattatgagtgtgactttagctattactggagagcatattcaaagcctcaatgaaagtggttttgtgccgatagcagaaagtgaagtaacacaagaggaaatcgattccgcacttcatacagcaagctcaataaaattgccagaaggcttatctttattgcatgttattccacaagaatacgctgttgatcgtcagatgaacattaaaaatccattgggattacaaggcgtgcgtttaaaagcacaagtacatttgatcgcttgtcatcaagattggcaaaataacttaaaaaaagccgttgaacgttgtggattgcaagtggataaagtggttttctctggttttgcagcaacacattctgtgctaactgaggatgaaaaagatctcggcgtgtgtttaattgattttggtgctggcacaatgaacgtgatggtttatacgaatggcgcattacgttttagcaaggtaattccttacgcaggaaatattgtgacaaatgatattgcgcacgcttgtacaatttcgcgagcagaagcagaacggatcaaagtgaactatgctagtgcattttacccagctcgtttgcacggagataaaaaaattgaggtggcaagtattggcggtcgtgcgcctcgttcattaacaaaaagtgatttatctttaattacatcagctcgttatacggagcttttaggcgtggtaaaagatgaattagataagttaaaagctgaattagaagcaaaacatattaaatttgaattaattgcaggtgtggtaataactggtggtggagcgcagattgaagatcttaaagaatgtgcttcaaatgttttccattgtcaggtgcgtattgcgagtccattaaatattactggtttgactgattacgtgaatcgtccacaatattcaacggtggtgggattattgcaatataatcacagtaatagtgatgatgatttaatttcaggaagtgatgattctgaaggaactttctttgaatctatttggcaaggagtaaaaaaaattgtcaataaagtgcggtcagaattttga

SEQ ID NO: 1933 - DNA, 1266 bp, H. influenzae strain 86-028NP
atgctatacccagagtaccctgagtacgataattttaacgaatccggcgcactgatcaaagtcgtaggtgtaggcggtggcggtggcaatgccgtaaaccatatggtaatgaatatggtaaaacaagaaatgggcggaacctttgttggcgaaagttcattaacatcagaggaacacggtcgcatagtattttatgccgtcaatactgatgctcaagcattgcgtaaaagtcaagttcaacagaccgtacaaattggtggagaaacaaccaaaggtttaggtgctggggcaaatccgaatattggtcgtaaggcagctgaagatgatcaggatgaaatccgtaaaatgcttgaaggtgccgatatggtctttattgcagcaggtatgggtggcggcacaggtacgggtgcggcacctgttgttgctaaaattgctaaagaactgggtattttgactgttgctgtagtgactaaaccttttgcctttgaaggcaaaaaacgtatgcaatttgcagagcttggtattaaagatttatcccaatatgttgattcaatgattattattccgaatcaacaaatccaaaaagttctccctaaaaatgctaaattaattgatgcttttgctgctgcaaacgacgtattgcgtaattctgtaatgggaatttcagatatgattacctctcctggtttaattaacgtggacttcgctgatgtaagaacggtaatgtcagttcaagggcaagctatgattggttttggttcagcggtgggagaacccggtgcgggtagagcagaagaggcggctcgccttgcggtacgtaacgatcttctagaaaaaatcgatctttctaacgctcaaggaattttagttaatattactgctggaatggatttagtttttgatgaatttaacattataggtgagacaataggaagctttgcttctgaagaggcgacggttgttgttggtacgagtttagtgcctgagatgagcgatgaaattcgtgtaactattgtggcaactggtcttggtgaaattgcaggaaatgagccaattcaagttgttcgtcaagggctttctacgcagaatattgaaggcgaagggcgtgtaaacattgttcctgaacttcatcgtcgtgaatctgttgaagtgtcaaggtctgcatcagaagaatatcaacgaccgttagataaaccgattacagatcgcttggaagcatttaagaaaaataatttttttaatcctgcacagcgtgaagaaaattaa

SEQ ID NO: 1934 - DNA, 918 bp, H. influenzae strain 86-028NP
atgattaaacaaagaacattaaaacaaagtattaaagtaacaggcgttggcttacatagcggtaataaagtgacattaaccttacgcccagctatgccaaacacaggtgttgtttattatcgtacagatttaaaccctgcggtggcatttcctgccgatcctaattcagtgcgtgatacaatgctctgcacagcactaattaatgatcaaggtgttcgcatttctaccgttgagcatttaaatgcagctttggcagggcttggtattgataatatcattattgaagttgatgcccctgaaattcctattatggatggcagtgctagtccgtttatctatttgttgttagatgcgggaattgaagaacaaaatgcagcgaaaaaatttattcgcattaaagaatatgtacgagttgaagatggcgataaatgggctgaatttaaaccttataatggtttccgtttagatttcactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagcattaggtggtagccttgataatgcgattgttcttgatgattatagaatcttaaatgaagatggcttacgctttaaagatgaacttgttcgtcataaaatgttagacgcaattggcgatctttatatggctggttataacattatcggtgattttaaagcctataaatcaggtcacggtttaaataacaagttacttcgtgctgttttagcaaatcaagaagcgtgggaatttgtaacctttgaagataaagagcaagtgccacaagggtatgtagctccagcgcaagtgcttatttaa

SEQ ID NO: 1935 - DNA, 1158 bp, H. influenzae strain 86-028NP
atggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagactcggtattgacccagcaagtctacttgcagaataaacttaatgaacaacgtaatcaaaatttacatattgcttttttaggtaaacgtggttcttattctaatttagctgcacgtaattatgctgctcgttatcaaaaacaatttgtagaactaggatgtcagtcttttgatcaagtatttgaaaaagttcagactggagaagctgattttggtgtattgcctttagaaaatacaacatcgggtgcaattaatgaagtttatgatttacttcagcatactgatttatcattagttggagagttggcttatccaatcaaacactgtgtgcttgtcaatgataaaacagatttgagtcaaattgatacgttgtatagtcatcctcaagtgattcaacaatgtagtcaatttattcatagtcttgatcgtgtgcatattgaatattgcgaaagcagttcacacgcaatgcaattagtcgcaagtttgaataaacctaatattgcagcattgggtaatgaagatggtggaaaattgtatggacttagtgtattaaaaactaatattgctaatcaagagaacaatattacacgttttattgtggtggctaaagatcctcgcgaagtttcatcacagattcccacaaagaccttattattaatgacaacttcacagcaagctggcgcgttagtggatgctttattggtgtttaaaaagcatcaaataaatatgacaaaattggaatctcgaccgatttacggtaagccttgggaagaaatgttttatctagaaattgaagcaaatatccatcatccagatacgaaacaggctttggaagaactaaaaaattatagtaattacttaaagattttaggctgttatcctagtgagattgtaaagccagtgagcgtgtaa

SEQ ID NO: 1936 - DNA, 858 bp, H. influenzae strain 86-028NP
atggaaattatcattattagtgggcgttctggtgcaggaaaatctgtagccttacgagcattagaagatacaggatattactgtgttgataatattcctttagatttgcttcctcaattgactgatattctgtctcaatctcaatcttcggtcgccattagtctcgatattcgtaatattccaagctccgctaattctcttgagcaaaccctttcaacgttacaaaagcatcatcaaattaaaatcattttcttagaggctgatcgcgctaccctgattcgccgatatagcgattcacgccgtttgcacccgctttcattaaaagatctatctcttgaagctgcaatagatgaagaatatcgctatcttgagccattgattcaacacgcaaatcttattcttgataccacccatctttctacgcatattcttgcagaacgattacgcgaatttttacgcgataatagtgaaaaagaattaaaaattattgttgaatcttttggttttaaatatgggattcctttagatgcggattatgttttcgatgtccgctttttacctaacccccattgggatccaacattacgcccaatgactggattagaagcccctgtcgcagaatttctaaatagtcatacagaagtcaatgaatttatttatctcactcgtcattacattgatacttggttgccaatgttagaaaaaaataaccgtagctatttgacgattgccattggatgtactgggggaaaacatcgctccgtttatattgcccagcagttaggcgaatattttcaagccaaaggaaaaacggtacaaattcaacataaatctttagaacggaacaaaaaaatataa

SEQ ID NO: 1937 - DNA, 495 bp, H. influenzae strain 86-028NP
atgaaaataactgaactattaagctctgagaatattcgtcagggcgttagtttttctagcaaaaaacgattatttgagtctattgcgcattttgtagaagaacaaatccttgcagaacaaggcgaacaagcctgttttgaatgcctttttgaacgtgaaaaactggggaattctggtttaggaaatgggattgcaatgccaaaagcaaaaatccccgtaacagtatcagataaagcaatcgcagtgtttatgcaactcgataatccgattgattacgatgctgttgatagtaaaccagtggacttaatctttgccttactgattccagaaaatcaatgtgaaagctacattccagttttagcatcattaatagaaaaactgactgataaaaatgtgttgaaacaattacgatcagccaaaagtgcggatgaaatttggcaagtttttgaaattaccgatcaatcagaaacgacacttgaagaagtgaaagaataa

SEQ ID NO: 1938 - DNA, 726 bp, H. influenzae strain 86-028NP
atgtcaattttgactgcagagaatttagctaaaagctacaaaagtcgtaaagttgtttcggatgtcagtttaaccgtaaattctaatgaaattgtcggtttgctcgggccaaacggtgcaggtaaaacaaccacgttctatatggtcgttgggcttgttcgccaagatcaaggcaaaattgttattgatggcgaagacattagtttgctcccaatgcataatcgtgcgcaacgtggcattggttatttaccgcaagaagcctcgatttttcgccgtttgactgtctatgaaaatttgatggcggtattggaaattcgtaaagatttaaccccacaacaacgtcgcgaaaaagcagatgaattaattgaagaatttaacattagtcatattcgagataatttagggcaagccttatcaggcggcgaacgtcgccgtgtagaaatcgcacgtgccttagctgcaaatccaaaatttattctattagacgaaccttttgctggtgtagatcctatttctgtgagcgatattaaaaaaattatcaccgacttacgtaaccgaggattaggtgttttgattaccgatcataatgtccgtgaaacccttgatgtttgcgaacgcgcttatattgttggtgcaggtaaaattatcgcaacaggtacaccggcacaagtgatgaacgatgaacaggttaaacgagtttatcttggcgaacaattcaaattataa

SEQ ID NO: 1939 - DNA, 519 bp, H. influenzae strain 86-028NP
atgaagttagtaagcaataaaattctttttcttgcaacgatggtattagcatcaagttcagcttttgcattgaaagatgacgttaatcagccgataaatatcgtttcggataatcaatccttagatatggaaaaaagtgtagtgacattcacagataatgtagtaattacacagggatctatcatcattaaagcaaataaagttgttatcactcgtcccgctgaaaaatcagggaaaaaagaaactgtagaagcatttggtacgccagtcacattccatcaacagctagataatggcactccaatagatggaaaagcaaataaagttcattatgatcttggcaacgaatttttaacattaactaacaatgccgaattaaagcagcttgatagtaaaattaatggcagtgttattacctatgatgtgaagaaacaacaacttaaagctaatggtaatggaaaatcacgggtaacaacagttcttattccatctcaattacaacaagctaaagggaagtaa

SEQ ID NO: 1940 - DNA, 609 bp, H. influenzae strain 86-028NP
atgaatattcgttggaatgtaattttgggcgttatcgcactttgtgctttggcgtggttttattccttaaatcaggaaaccgcagatttatctgaacttgtgaaaaaaccagatagtcctgattatgtgggttataaaatggaaacaacggttttttcccctgagggtaaaaaacaatatttggctttatccgataaaattgagcattatacagtcaatgaacaaaccctttttaccgcgcctttagtttatttatatcccacaacatcaaatgaaaaggaacaaaatcccaatcaaaatgtagatttttttagcacacaaaactggaaattaagcgcaaatcaagcaagattgacaaaagatcaaatattgtatttagagggtaatgtcgtcgtgcaaagtttaacatcagattctcgtttgcaacgcattgaaacagaatcagcggtcgtcaatttaaaaacacaggatatgacttccgaaacacaggttaaaattaaggggaaaaattttagttctacaggattaaaattagtcggaaatttacgccaacaagtggcgacattaaaggaacaggtaaaaacatattatgaagttagtaagcaataa

SEQ ID NO: 1941 - DNA, 537 bp, H. influenzae strain 86-028NP
atggcaaaacgtaagaaaaaagaagttttcgattgggaagatgaagatcaagaagaaattatttgggtgagtaaaagcgaaatcaaacgcgatgcggaagatttaaaacaacttggcgaaaagattgtcaatttaaccaaagctaatcttgccaaaatcccacttgatgaatccttacttgatgccattgaacttgcacagcgtttacaaaaagaagctcgtcgccgtcaattacagtatatcggcaaattatttcgaggaattgatgttgaacctattcgtgaagccttagataaaattgaaaataagcataatcaacaacaagctatgttgcacaaaatcgaaaaagtgtgcgatgaattggtggaaaaaggtgatgtggctttaactgatttactaaatgattatcctgatggcgatcgtcagcaactacgcaatctgattcgttctgcacaaaaagaactggaacaaaataaaccatcaaaagcctatcgagaaatttatcaaatgctcaaggtattaatgttggaagattaa

SEQ ID NO: 1942 - DNA, 1356 bp, H. influenzae strain 86-028NP
atgaaaacagctgaaaattcaaccgcacttttaaaagcacaagaacaagaattacgtcaagccgtcagttttgcagtggcgttagcaacgaaagctggcgcgagtgcagaagtcgcggtcactaaagtgagcggtttatctgtatctgctcgtttgcaagaaattgaaaacgtagaatttactaatgatggtgcattggggatttctgtttatatggggcaacaaaaaggcaatgcctcgacttccgatttaagcgaaagcgcaattaaaaatgcagtggaagccgcacttgctattgcaaaatacacctcgcctgatgattgcacagggttggctgataaagatctaatggcttttgatgcgcctgatttagagctttatcatgctgctgatgtggatgttgataaagcaacagaacttgcacttcaggctgaaaaggcggctttagaggcggatgaacgtattataaatagtaatggcgcaagttttaattcacatacaggcgtgaaagtgtatggtaatagtcacggtatgttgcaaagttatttatcaagccgttattctttatcttgttcggttattggtggcgtagaagctgccttagaaaatgattacgaatatacaatttctcgtgaattcgacaaactccaatcgccaatttgggtcggagaaaattgtgcaaagaaagtcgtttctcgtttaaatcctcaaaaattgagtacacgagaagtgcctgtcattttcttaaatgatgttgcaactggtcttatttctcactttgccgctgcaataagtggtggcagtttatatagaaaatcgagtttcttgctcgatcatttaggcaaacaggtcttaccagattggttcaatatcagtgagagaccacatttattacgtcgtttggcttcaacgccttttgatagtgaaggtgttcgtacgcaagatcgtgaaattgttgaaggcgggatattacaaacttatttagtgacaagctacagtggtaaaaaacttggtatgccaagtacagggcatgctggaggcattcacaactggcttgttaagccaaatttaacgggaggattgaccgcacttttacatcaaatgggaacgggattgttagtaacagatgtgatgggacaaggtgtcaatatcgttacaggcgattattcccgtggtgcatcaggtttttgggtggaaaatggtgaaattcagtatccagtggctgaaattaccattgcagggcaactacaagatatgctgaaaaatatggttgctgtagccgatgatatagagcatcgttctaacattcaaacgggttctattttgttagataaaatgaaaatttcaggaaattaa

SEQ ID NO: 1943 - DNA, 540 bp, H. influenzae strain 86-028NP
atgaaaaaacaccacgtagatgttttaatctcagagaatgatgttcatgcgcgtattgctgaattaggtgctcaaattacaaaattttatcaagaaaaacagatcgatagccttgttgtcgtagggcttttacgtggttcctttatgtttatggcggatatcgttcgtcagataaatttacctgtggaaattgaatttatgactacttcaagttatggcactggcatgaccacgaatcacgacgttcgtattaccaaagatttggacggcgatataaaaggtaaacacgttttaattgtggaagatattattgatacgggttatacgttggaaaaagtgcgtgatattttgaatttacgtgagcctgcgagccttgcaatttgtacgttacttgataagccttctcgtcgggaagtggaagtgcttgttgaatgggttggttttgaaattcctgatgaatttgttgtggggtatggtatcgattacgcgcaacgccatcgtaatttaggctatatcggtaaagttgttttagaagaataa

SEQ ID NO: 1944 - DNA, 1323 bp, H. influenzae strain 86-028NP
atgttattagtcaatttggcgatatttattgcttttttattgctgttagcacagctatatcgcaaaaccgaaaaattagggcaaacggtatttatcggtttattgctcggtttgctttttggtgcggtattgcaatccgcttttgaaaaacctttgttagacgaaactttagattggatcaacgtggtcggtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcgacaattccgttaaatattgaaacgcaaaccgcaaaattaggtaacaacaatgtcatcgccaactttgctgcctcattcggtgccactatcggacaaaacggctgtggcggcatttatccagcgatgcttgctgtaatggtcgccccaatggtcggcattgacccttttagcttcagctacattctaaccttaattttcgtggtcgccatttcttcattcggtatcgcaggcgtaggtggcggagccacattcgccgctatcgtcgtgctatctacgttaggtttaccactggaattagtcggtttactcatttccatcgaaccgatcatcgatatgggacgtaccgcacttaacgtaaacggtgccatggtggctggcacgattacggatcgcttgctaaataagtaa

SEQ ID NO: 1945 - DNA, 468 bp, H. influenzae strain 86-028NP
atgaactacctccaatactacccgaccgatgtgattaatggcgaaggcacaagatgcacacttttcgtcagtggctgtacgcacgcttgcaaaggttgctacaaccaaaaaagttggtcattttcagcgggtgtattatttgatgacgcaatggaacaacaaatcatcaatgatttaaaagacacacgcattaaacgccaaggtctcacgctttcaggtggcgatccacttcatccccgtaacatagaaacattattgccctttgtgcaacgtgtaaaacgagaatgccccgataaagacatctgggtttggacgggttataagctagatgaattagacgaacaacaacgtgctatgttgccttatattgatgtattaattgatgggaaatttattcaagaacaggctgacccaagtttagtttggcgaggttccgcaaatcaaattattcatcgatttaagttataa

SEQ ID NO: 1946 - DNA, 1731 bp, H. influenzae strain 86-028NP
atgcgcacattacttccgtttatacgtttatttaaattcgccaaattcccgcttattttaggcttggtgctaatgattctaggtttgggctctagtatgggcttgcttaccgtttcaggctggtttttagccgctacagccattgcaggactaggcacgctatttaactttttctatccttcagccagtgtgcgaggtttagctatcggacgaaccgtcatgcgctattttgaaaaaatagtaacgcatgatgcaacattccgcattttgtccaaattacgcgtgcaagtatttgaaaaaatcattcctttaagcccagcggtattaaatcgttatcgcaacagcgatttattaaatcgtttagtttccgatgtggatacccttgatagcctctatttacgtttacttgcgccatttttcactgctgtatttgtaatcattgccataaccattggacttagctttatcaatattccactcgcacttggtttaggcttatttttattaattttattaatgattatcccaactgttttctatcgactaggacagcaatttggcgaacgcttaatccaagcacgcgcgacctatcgaacccagtttttagaatttatccaagcacaagccgagcttttattatttaatgcggaagatagattaaaagaaaaaatgtcagccacagaaaaaacatggcaggaagatcaagccaaagaagcaaaattaagcggattctctaccgcacttgttctctttcttaatggtttgttgatttctggaatgctatggtttgcaagtaacgccgattttggcacagatgaatatcgcacggcttatattgcacttttcacttttgctgcacttgccgcctttgagattatcatgccattgggggcagcatttttacatataggtcaagttattgcggcagcagaacgtgtgaccgaaatcattgagcaaaaaccgattgttgagtttaatggcaacgaggaatttgaaacaaaagtgcggttaatttctgcgaagaatttaaatttttcctatcccgaacaagaaacactcgtattaaaaaatcttacattagatttagaacagggcaaaaaaattgctattttaggcaaaactggaagtggaaaatcttcacttcttcaacttttagtacgcaattatgatgcgaatcaaggtgaacttttattggcagaaaaacccatttccgcctattcagaagagacattacgccgccaaatttgttttttaactcaacgtgttcacgtattcagcgatacacttcgtcaaaatttacaatttgcaagtgcggataaaatttctgatgaacaaatgattgaagtactacatcaagttggcttaagtaaattacttgagcaagagggaaaaggtttaaatctttggcttggggatggcggtcgtccactttctggtggggaacaacgccgtttaggtttagcgcgtattttactcaataatgcgtcaattttattattggatgaaccgactgaaggcttagatcgcgaaactgaacgtcaaattttacgtttaattctgcaacatgccgaaaataaaaccctaattatggtcactcaccgtctcagttcaattgaacaattcgataaaatttgtgtaattgatagcggaagattaatcgaagaaggcgattacaatagtttaatcactaaagaaaatggtttctttaaaagattgattgagcgagtatga

SEQ ID NO: 1947 - DNA, 1761 bp, H. influenzae strain 86-028NP
atgaataaacttcgccaaaaatatttacaaaaatggcttcgcgcacaacaagaacctatcaaaaaattaatgcgtgcaaacattgtcttagctacgctttcttcattcattttagtcgcacaaacttattttcttgcgacgttgctcgataaactgattatgcaaaatgtgcctcgtgatgaacttattccttattttctcgggctaattatcggcttcgggatgcgtgctattattttatgggcacgcgaaaaaataggtttccaaagcggacaattattacgcaaccatattcgtcaaaaaattctggataaaattcatcttgtcggccctgcgacaatcaatcaaaaaccagctggaagttgggcaagcattatgttggaacaagttgaaaacttacataatttctatgcccgttttctgcctcaacaaagtctttcagccattgttccagtggttattttcattgctgtatttcccttgaactgggctgcaggcttaatcttaatgattaccgcaccgcttgttcctctgtttatgatcattgtcggtattgctgcggctgacaacagccaaaaaaatatggataccctttctcgcctcagtgcccaatttttagatcgcttacgcggtttggaaaccttgcgtctttttaaccgcacttctgaacaaactgagcatattgaaaatgccactgaagatttccgtgaaaccacaatggatgtgctaaaactcgcttttctctcttctgcagtattggaattttttacctctatttccattgcactgatggcggtctattttggttttagctacttaggtcaaattgaatttggtacctataatgcaccgcttacacttttcacaggtttcttttgtttaattcttgcacctgaattttatcaacccttacgcgatctaggcacctattaccacgaccgtgcagcaggtattggtgcagcggatgccattgttgattttttagaatctgattatttaactgtacatcaaaatgaaaaaacaatttctttagaaagtgcggttgaaatttctgccgaaaatttagtggtgctttcgacacagggttcagcattaaccaagccgttaaacttccaaattccagcaaatcataatgttgcgcttgtaggacaaagtggcgcgggaaaaacttcattaataaatgcgattctgggctttttaccttatgagggctcgctcaaaattaatgggcaagaacttcgcgaaagtaatctagctgactggcgcaaacatattgcgtgggtaggacaaaatccattgttattacaaggcacaattaaagaaaacttactacttggcaatattcaagccaacgatgaagaaattaatcaagctttaatgcgttctcaagcgaaagaatttaccgataaacttggacttcatcacgaaataaaagatggtggattaggcatttctgtgggacaagcgcaacgccttgccattgctcgggcattgttacgcaaaggcgatttacttctgctcgatgagccaaccgcaagcctagatgcgcaatcagaaaatcttgttttacaagcattgaatgaagcaagtcagcatcaaactacactgatgattacacaccgaattgaagatttgaaacaatgtgatcaaatttttgtgatgcaacgaggagaaatagtacagcaaggtaaatttaccgaattacaacatcaaggtttctttgctgaactactcgctcaacgacaacaggatatccaataa

SEQ ID NO: 1948 - DNA, 957 bp, H. influenzae strain 86-028NP
atgtcagatatcaaacacgcaaaacttttaattttaggctcaggccctgctggttatacagcagccatttatgcggcacgtgcaaacttaaaacccgtactggtgactggtttacaacaaggtgggcagctgactaccacagatgaaattgagaactggccgggtgattttgagatgactactggttcaggtttaatgcaacgtatgttgcaacatgcagaaaaatttgaaacagaaatcgtcttcgatcatatcaatcgcgtagatttatcttctcgcccattcaaactttttggcgatgtgcaaaatttcacttgtgatgcattaattatcgcaacgggtgcctctgcacgctatattggcttaccttcagaagaaaactacaaaggtcgtggggtttctgcttgtgcaacctgtgatggtttcttttatcgtaataagcctgttggtgtcattggtggaggaaatacagcggtggaagaagccctttacttagccaatattgcaagtacagtgcatttaatccaccgtcgcgatagcttccgtgcggaaaaaatccttatcgaccgtttgtacaaaaaagtggaagaaggaaaaatcgttcttcatactgaccgcactttagatgaagtgttgggtgacaacatgggcgtaaccggattacgtttagccaacacaaaaactggggagaaagaagaactcaaattagatggcttattcgtagcgattggtcactcgccaaatacgaaaattttccaagggcaactagaattaaataatggctatatcgttgtaaaatctggtcttgaaggaaatgcaaccgccacttctgtggaaggcgtgttcgcagcaggcgatgtcatggatcacaattatcgccaagccatcacctccgcgggaactggttgtatggcagccttggatgcagaacgctatttagatgctcaagaagcataa

SEQ ID NO: 1949 - DNA, 858 bp, H. influenzae strain 86-028NP
atggctgattttccttttatcgttgagatcaacgaacaaaatcttactgaaatactgcaacaatccttagaaaaaccacttgtcatcaatttttacgcgccaacccataaagaatcggcggattttttggtgctacttgagcaagttgcagaacaatatcaaggacaatttattcttggaaaagtagattgtgaaaaagagcaaatgattgccgcacaattccgcatccaagcattgccaaccacctatttgtttaaagaagcacaggcattagaggcatttccaggcatgcttgataaagcatcattaatccaacgattaagcattattttacctaaagaggaagatttaaaattccaacaagcattagatttcttgcaagtagaaaattacgaagccgcattgccattgttgaaagacgcatgggaactttccgataagaaaaacagtgatgttgccctgctctatgcggaaacctatattgcaatgaagaaaacggagccagcacaagaaattttaaatcaaattccattgcaagatcgagatagccgttggcacggattacaagcacaaattgagctacaaattcaagcagccgatacacctgaaatccaacaattacaggctgattatgctaaaaacccaacagctgaaattgcaataaaacttgccgtacaacttcatcaagctggacgaaatgaagaagcattaacactacttttcggcattttaaaaacagatttaagcgcgcagaatggcgaagttaaacaacaatttttatctattttaagcgcaatgggcaatgctgatccgctgacaaataaatttcgtcgattgctttattcgctgctttattaa

SEQ ID NO: 1950 - DNA, 972 bp, H. influenzae strain 86-028NP
atgacaaaatccgcaaaaatcggcgtattacttgccaatctaggcacgccagatagcccaacaccgaagtcaatcagccgttatttatggcaatttttaacggatcctcgcgtggtagatttaccccgttgcaaatggtatccactgcttaaagccattattttaccattgcgttcaaaacgtatcgccaaaaattatcaagcaatctggacagaacaaggttcgcctttacttgccatttcacgacaacaaaaagacgcattacaagcctatttagatacgcaaaatatcaatgctcaagtagaaattgccatgacgtacggcaatccatcaatacaaagtacggtaaaaaatttgcttaaaaatcaagttgaacgaattattgttttgccactttatccgcaatactctagctcaaccacgggcgcagtatttgatgctttcgctaatgcccttaaagaagaacgaggattagtgccttttgatttcatccattcttatcatattgatgaaaattacattaacgccttagcaaactccataaaagtgcggttaaaatccgatgaatttttactattttcttatcacggtattcctctgcgttatgaaaaaatgggcgattattatcgtgaacattgtaaacaaacgactattgcagttgttaataagctgggcttaacagaaaaccaatggggaatgacgtttcaatcgcgctttgggcgtgaagaatggctacagccttacaccgataaatttttagaatcagctgcaacacagaacattcaaaaaattgccgttatttgcccgggtttctccgtagattgtttagaaaccattgaagaaattgataaagaaaatcgagaaaatttcttaaccaatggcgggcaatcttatcaatatattcccgcactaaatgtagagcatacacatattgaaatgatgggaaaattgatcctagaaaaacttgcttaa

SEQ ID NO: 1951 - DNA, 417 bp, H. influenzae strain 86-028NP
atgatttggcaaaaaaacttcacgctcgaaaacttaaatcaactttgctccaacagtgcagttagccatcttggcattgaaatttctgcttttggcgaggattggattgaagcgacaatgccggtggattatcgtactatgcagccgtttggtgtattgcatggaggggtttctgttgctttagctgaaacaattggttcccttgcgggttcgctttgtttagaagaaggcaaaactgcggtgggattggatattaacgccaatcatcttcgcccggttagttcaggtaaagtgaccgcgagagccacgccaattaatttgggcagaaatatccaagtttggcaaattgacatccgcacagaagagaataaactttgttgtgtttctagattaaccctttccgtaatcaatttatga

SEQ ID NO: 1952 - DNA, 3084 bp, H. influenzae strain 86-028NP; identical to SEQ ID NO: 651

SEQ ID NO: 1953 - DNA, 1080 bp, H. influenzae strain 86-028NP
atgaaaaaaactgcaatcgcattagtagttgctggcttagcagcagcttcagtagctcaagcagctccacaagaaaatactttctacgcaggcgttaaagctggtcaaggatctttccatgatggtattaacaataatggcgcaattaaacagaatttatcatctgctaattatggttacagacgcaatactttcacttatggtgtatttggtggttaccaaattttaaatcaagataattttggtttagctgctgaattaggttacgacaattttggccgtgtaaaacttcgtgaagcaggaaaacctaaagctaaacatactaaccacggtgcgcacttaagcttaaaaggcagctatgaagtgttagacggtttagatgtttatggcaaagcaggtgttgctttagtacgttctgattataaattttatgaagttgcaaacggtactcgtgaccacaagaaaggtcgtcacacagcacgtgcctctggtttatttgcagtaggtgcagaatacgcagtattaccagaattagcagttcgtttagaataccaatggctaactcgcgtaggtaaataccgccctcaagataaaccaaataccgcaattaactacaacccttggattggttctatcaatgcgggtatttcttaccgtttcggtcaaggcgaagcaccagttgttgcagcacctgaaatggtaagcaaaactttcagcttaaattctgatgtaactttcgcatttggtaaagcaaacttaaaacctcaagcacaagcaacattagacagcgtctatggcgaaatttcacaagttaaaagtgcaaaagtagctgttgctggttacactgaccgtattggttctgacgcgttcaacgtaaaactttctcaagaacgtgcagattcagtagctaactactttgttgctaaaggtgttgcagcagacgcaatctctgcaactggctacggtaaagcaaacccagtaactggtgcaacttgtgaccaagttaaaggtcgtaaagcgcttatcgcttgtcttgctccagaccgtcgtgtagaaatcgcggtaaacggtactaaataa

SEQ ID NO: 1954 - DNA, 363 bp, H. influenzae strain 86-028NP
gtgataaaatgcttacctcgtttatttatagggaacattatggaaaccttagacaaaatcaaaaagcaaattagtgaaaatcccattcttatttatatgaaaggttcgccaaaattaccatcttgtggtttttctgctcgtgcatctgaggcattaatgcactgcaaagtgccttttggttatgtggatattttgcaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaa

SEQ ID NO: 1955 - DNA, 1101 bp, H. influenzae strain 86-028NP
atgcagtacattaacattgccaatcgtggcgtaaaatccttatcaccttaccaagctggtaaaccgattgaagaattagaacgagaaattggtatttccaatatcgttaaacttgcctcaaacgaaaacccatttggttttccagaaagtgcaaaaaaagcaattttcgaacaattagataaactgactcgttatccagatgcgaatggctttgaactaaaacaaactatcgcaaaaaaatttggcgttcaaccaaatcaaattacactcggtaatggctcaaatgatttattagaactttttgctcacactttcgcaacggaaggcgatgaaatcatttattcacaatatgcttttattgtttatcctttagtgactaaagcgataaatgcaattgcaaaagaaattccagctaaaaattggggacacgatttacaaggatttttaaccgcactttctgataaaacaaagctcatttacattgctaatcccaataatccaacgggtaattttttaacatcacaagaaattgaagattttttagcaaaagtccccgaaaatgtaatcgtggtattagatgaagcctacacagaatttactagatctgaagaacgagtggactctttcagtttattaaaaaaatattcaaatttaattatttcacgcactctttctaaagcctatggcttggcaggcttacgcattggttatgcggtatctaatccagaaatcgcagatttattaaatcgagttagacagccatttaactgtaattctttggcattaaccgctgcagttgccgtaatgaatgacgatgaatttattgaaaaagtcgctgaaaataatcgaatagaaatgcgacgttatgaagacttttgtcaaaaaaatcaattggattatattccctctaaaggaaattttataaccattgatttcaaacaacctgccgcaccaatttatgatgcgttgttacgagaaggcgtaatcgttcgcccaattgctggttatggcatgccaaatcatttacgtataagtattggtttacctgaagaaaacgataaatttttcaccgcactttctaaggtattaaagtttgcttaa

SEQ ID NO: 1956 - DNA, 1089 bp, H. influenzae strain 86-028NP
atgtcacaagtctttaattttagcgcaggtcctgcgatgattttcccagaagtgttgcaaaaagcacaaaatgaacttacaaactggctcaatcaaggtgtttctgtaatggaagtaagccatcgtggaaagtattttatggaactcgttacccaagcggaaaaagatctacgtgaggtttacaatattcctgataactatcgtgtacttttcttacaaggtggcgctcgcggtcaatttgccgcaattccgatgaacttaatcggtaaaaaaggcaaagccctttatttaaatagtgggcattggtcagctacagcggcaaaagaagcaagaaattttgcagaaattgatgaaatcactatcgtagaaaatggcgaacagactcgaattaccgatcttgattttagccatatcgctgatcaatatgactacgttcattattgcccgaatgaaactattagtggtgtagagatttttgatgtgccaaatgtgggcaatgccgtattggtcgcggatatgtcttcaaatattctttcacgtcaaatcgatatcagtaaatttgggataatttatgcaggtgcgcaaaaaaatcttggccctgcgggtattacgttagtgattattcgcgatgatttaatcggtaatgcacgtaaagaaaccccctctatttggaattatgcaactcaacgtgatgcagattcaatgatcaacacgcctccaacttttgcgtggtatttatgttccctcgtatttaaacatcttaaagaaataggcggcttagaaataatcgaaaaacgtaatgcactaaaagcacaaactctttatgattatattgattcgagcaaactttaccgcaatgtggtagcaaaagaaaaccgttcaacaatgaatgtcactttcatcacaggtaatcctgaattagatgcaaaatttgtcgcagaatctactgctacgggtttgcaagccttgaaaggtcataaggttttaggtggaatgcgcgcatctatttataatgcaatgtcgcaaaatggtgttgaggcactcatttcatttatgaaaaaatttgaagctgaaaatcttcctcaatag

SEQ ID NO: 1957 - DNA, 345 bp, H. influenzae strain 86-028NP
atggaaattgtgaataaacaatcttttcaagaagtgttggaatacgtgcgtatgtatcgtttaaaaaatagaattaaacgagatatggaagacaataatcgtaagattcgcgataaccaaaaacgcatattgttattggataatttaaatcaatatattcgtgatgatatgactattgcagaagtacgcggaattattgaaagtatgcgtgatgattatgaaagccgtgtggatgattatacaattcgcaatgctgaactttctaagcaacgccgtgaagcgagtacgaaaatgaaagaacagaaaaaagcacacgcagaattattgaaaaatgctgaaaaataa

SEQ ID NO: 1958 - DNA, 567 bp, H. influenzae strain 86-028NP
atgtatcctctatttgaaaccctttgtattgaaaacgggaaaattcaaaatatcgatttacaccaagcgcgatatgaacgtagtttgcgtgaatattatggcaaaagtgcggtgaaaatttttaatcttttttcccttattcaactgcctgaagatttacaaaatcaattagttcgctgccgcattgattacaatgccgaaaccacacaaattcaatattttgaataccaacgaaaaatctaccgcacttttcaacctgtaatttgtgatgacattgaatatagtttgaaatatttagatcgcagtttaattaatacattatttgctcaacgtggtgcttgtgatgaaattatgattatcaaaaatggaaaagtgacagattgttccatcggtaatttaatttttcgccaaggaaaaaaatggtacacgccagacacgccattgcttttaggcacacaacgagaaaaattattacaagaagggaaaattcaagaacgcacaatattccaagaagatattgtcaattttgatgaaattaaaatcattaacgcaatgaatagcttataa

SEQ ID NO: 1959 - DNA, 987 bp, H. influenzae strain 86-028NP
atggcacaaagcacaatgcaacattttattgaacaggctaatcattatggcaaacaacgcacgccatttttctttcttattgattttgaaaaagaaaaacccttgatttgtcctctcgaaaattctgcacaacaaggcatttattttgatattttaggcaaaagaaattgcacgatttctccacaatctctccctcttaatttcaccaaacatccaatgcctttctcgcattatcaacaaggttttgaacttgttcaaagtgaattacaaaaaggtaattcttatttattaaatctcacctaccccactgaaatttcaggtaatctgtcacttgaacaaatttttcatcaaaccaatgcaccttataaattgtggttacaagatcaattcgtttgcttttcgcctgaatgttttgtcaatattcatgacaacaatatttttacctatcccatgaaagggacaattaatgccactctgcccgatgcagaaaatcagttactcacaaatgaaaaagaacaacgcgagcattacacgattgttgatttaatgcgtaatgatttatccatggtggcagaacacattcaagtgaaaaaatttcgttatatcgatcgcatcaaaacacaaaaaggcgaaatactgcaaaccagttctgaaatttacggaaaatcgaatgaaaactggcaaaatcaaattggtgatattttagagaaactgttgcctgctgggtctattagtggtgcaccaaaagaaaaaaccacacaaattattcaacaagcagaaaaacaaaagcgcggttattacacgggaatttttggcatatttgatggcaaaacactacaaagtgcggtagcaattcgatttatttctcaagtagatgaaaaattttattttcatagtggaggcgggattaccattcatagcaatgcgcaagatgaatatgaagaattattagaaaaagtctatttaccgattgaaggtgctgattaa

SEQ ID NO: 1960 - DNA, 582 bp, H. influenzae strain 86-028NP
atgaaattactcatcattaataatcacgattcttttacttttaacttggtggatttaattcgaaaattaaatgtgccttatgatgttttaaacgtggaagatttaaaggaaagtacagcggaaaaatatagtcatatattgatttcgccagggcctgatataccacgcgcttatccacaacttttttctatgttggaaaaatattatcagcaaaaatctattttaggtgtgtgtttagggcatcaaaccttatgtgaattttttggtggtacattgtataacttagagaatgttcgtcacgggcagaaacgaacattaaaagtgcggtcaaattctccattgttttttgatcttccaactgaatttaatatcgggctatatcattcttggggcgtacaggaagaagattttcctgattgcctagaagttaccgcactttgcgatgaaggcgtggtgatggcaatgcaacataaatctttgccaatttatagtgtccagtttcatccagaatcttatatgtcagactttggcgagaaaattttgcgtaattggttggcgattcctccctcaactaacccataa

SEQ ID NO: 1961 - DNA, 1155 bp, H. influenzae strain 86-028NP
atgtctagctatttatttacatctgaatctgtctctgaagggcatccagataaaattgccgatcaaatttctgatgcagtacttgatgaaatcctaaaacaagatccaaaagcacgagtagcttgtgaaacttacgtaaaaaccggtatggcattggtgggtggggaaatcacaacctctgcgtgggttgatattgagaatttaacccgtaaagtgatttgtgatattggttatgaacattctgaaatgggttttgatggtcattcttgtgcggtgcttaatgcgattggtaaacaatctgcagatattaatcaaggcgttgatcgtgaaaatccattagatcaaggtgcaggcgaccaaggtattatgtttggttatgccaccaatgaaacggatgtattaatgcctgcagctattacttatgcacatcgtttaatggaaaaacaagctgaagtgcgtaaaagcggtaaattagcatggttacgcccagatgcgaaaagccaagtcacgttaaaatatgaagataataaaattgttggtgtggatgcggttgtactttctactcaacattctgaagaagttagccaaaaagatttacacgaaggtgtgatggaagaaattatcaaacctgtattaccaactgaatggctttctaaagaaacaaaattcttcatcaacccgactggtcgttttgttattggtggaccgatgggggattgtggtttaactggtcgtaaaattatcgtggatacttacggtggtgctgctcgtcacggtggtggcgcattctcaggaaaagatccatctaaagtagatcgttcagcggcttatgctgcacgttatgtcgcaaaaaatattgtggcagcaggtttagcagatcgttgtgaaatccaactttcttatgcgattggtgtggctgatccaacatctatcatggtcgaaacctttggaactggaaaagttgcaaatgaattattagtgtcattagttcgtgagttttttgatttacgtccttatggcttaattaaaatgttagatttaatccaaccaatctatcgtgaaacggcggcttatggccatttcggtcgtgagcaattcccttgggaaaaagtggatcgcgcagaagatttacgtattgcggcaggtttaaaataa

SEQ ID NO: 1962 - DNA, 516 bp, H. influenzae strain 86-028NP
atgacatcaatatcacttattccattccgtcatttaaaaatgcaagtgcaacgcaaattgaatcagtctttgctgcttgcagaggcttattttaagcgaaaatttacaatgccagaggtaaattatgagttacgaggtataaaggcaggcgtggcttacctacaaaaaaatgaaataaaatttaaccgcactttattgcaagaaaatacggatgaatttattcgacaagtcgtgccacatgagcttgcgcatttgattgtgtatcaaatgtttggtcgcgtaaaaccacacgggaaagagtggcagcttgtaatgaatgaaatttttaagcttcccgcagacacttgccatcaatttgatataaaaaacgtgcaaggtaaaacctttgaatatcgttgtgcttgccaaacccattttctaactattcgtcggcataacaaaataatgaaagaaaacatcgaatatttgtgtaaaaaatgtaagggaaaattagtttttgtcgatgatgaagaataa

SEQ ID NO: 1963 - DNA, 513 bp, H. influenzae strain 86-028NP
atgaaaaaatctttattagcagttattgttggtgcatttgcctttgcttctgttgcaaatgcgaatatttatgctgagggcgatatcggtttatctcaaactaaagcaaacggtagtaacaatacaagagttgaacctcgcgtatccgtgggttataaagtaggaaatacacgtgttgcgggtgattatactcatcatggaaaagttgatggcacaaaaattcaaggtttaggtgcatcagtattatatgattttgacacgaattctaaagtgcaaccttatgttggtgctcgtgtagcgactaatcaatttaaatacaccaatcgcgcagaacaaaagtttaaaagttcttctgatattgagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacgggttctaa

SEQ ID NO: 1964 - DNA, 306 bp, H. influenzae strain 86-028NP
atggaaaagttgaaaaccgcagctaatccaaatcaagctaagattgacaacgcaactaaatcttatgaaacagctaaaaatgaattagtttcaacttggaaaggcactgcgggttcggtttcagtggggaataaaataagaggcataacccgccaaattactggcatagctgcagggacttatcgaggacaatctgccgttgcagctggagtccgttatacgcctaaaccaaatatggtaattagcctttctggctctgctgataccaataacggtgattgttttaaacgatcaccgttaaattaa

SEQ ID NO: 1965 - DNA, 684 bp, H. influenzae strain 86-028NP
atgtttcaagaatatttaagcgtgatcgtacaagggattccaacgagtttactactcacagtcgtatccttactgattgctttctttttagccttatttcttacttttttactttcaatggaaaacaaatggataaaaagtgcggtcaatttataccttactttattcactggcacgccactgttagtacagttctttttaatttatgcagggccaggccaatttcaatggattattgacagcccattatggtatgtcttatccaatgcgtggttctgtgccgtattagctttagcactaaacagcgcagcttattccacccaattatttcacggtgcagtaaaagccattcctaaaggacaatgggaaagttgcgcagcgttagggttaagccgattacagacactcaaaatcttaattccttatgccttaaaacgtgcgttgccttcttacagtaacgaaattattttggtatttaaaggaacggcattagcatccaccattacgattatggatattatgggttacgcacgccaactttatggtacagaatatgatgcaatcacaatttacggcattgcgggtggtatctatttaattatcacaggcattgcaacattattactacgtaaattagagaaaaaagtattggcatttgaacgttttgaagtaagcaaagcataa

SEQ ID NO: 1966 - DNA, 666 bp, H. influenzae strain 86-028NP
atgttttctgactttctttctttaatgtttaccgctgctctaatgactttagggcttgcggtctgttcattgctcttaggcttatttttaagccttatttttgccgtgcttgaagcaaatcgctttgttggcaagccgatgacagtatttgtggcattattacgtggcttacccgaaattattgttgtattacttgtctattttggttctactgaattagtcgaaatactgacaggagaatacattgaatttggggcatttggctgtggtgtgtttgcgctttctctcatttttgcagcttatgcttcacaaacattacgcggtgcaattcaagccataccaaaaggacaatgggaatcaggtgcagcgttaggcttaagcaaaagctatacgttcattcatattgttatgccacaagtatggcgtcacgccttacctggtttaagcaaccaatggcttgtattgctaaaagatacggcattggtttcattaattggtgtggacgatttgatacaccaagcggatctgatgaataccaatactcatcaaccctttacttggtacggtattgctgcgttaatttatttagcggtaacattaattagccaagttggtattcgaaaattagagctgcgttttactcgttttgaaaggggcatgaaataa

SEQ ID NO: 1967 - DNA, 720 bp, H. influenzae strain 86-028NP
atgaaaaaaacattattaactgccattttattgggatcatctattgctgtaagcgcacaagaactcacttttgcaatggaacctagctatccaccatttgaaaccacaaatgaaaaaggcgaaattattggttttgatgtggatgtagcaaatgcaatttgtcaagaaattcaagcaacctgtaaattcaagagcgaaacctttgattcattaattccaagtttaaaagcaaaacgttttgatgcagcaatttccgcaattgatattaccgatgctcgtgcaaaacaagtgttattctctgatgcgtattacgatagctctgcaagctatgttgctcttaaaggcaaagcaaccttagaaagtgcaaaaaatataggtgttcaaaatggtacaacattccaacaatataccgtagcagaaaccaagcaatatagtccaaaatcctatgcaagtttacaaaatgccattttagacttaaagagcggtcggattgacattattttgggcgataccgcagtgctttccgatatgatttccaaagagccagaaattcaatttataggcgaaaaagtaaccaataaaaaatattttggtaatggtttaggtattgcaatgcacaaatcaaacaaagatttggctgcacaattaaacaaaggtttagctgcaattaaagcaaatggcgaataccaaaaaatctatgataaatggatgacaaaataa

SEQ ID NO: 1968 - DNA, 732 bp, H. influenzae strain 86-028NP
atggctattcgtgttaaaaatctcaatttcttttacggttcatcacaaacgttatttgatattaaccttgaagcggaagagggcgataccgttgtgttgctaggcccaagtggtgcaggcaaaagtacattaattcgcacattaaatttgttagaagtgccaaagtctggtgaattaagtattgcaaataatgattttaatttatccaatgcaatggcaaatcccaaagcaatccgacaattacgtcaagatgtaggaatggtttttcaacaatatcatctttggccgcacttaacggtaattgaaaacctaattgaagcaccaatgaaagtgcgtggtgtgagtgaaagtgaagcgaaaactgatgcaatggaattgttaaaacgtttacgtttagaacaacttgccgatcgctttccattgcatttatcaggcggtcagcaacaacgtgttgcaatagcgcgcgccctgatgatgaagccacaagttctattatttgatgaaccaacggctgcgctagatccagaaattacagcgcaagttgtagatattattaaagaattacaagaaactggcattacgcaagtgattgtaacccacgaagtcaatgtggcgcaaaaagtggcgacaaaagtcgtctatatggaacaaggtaaaatcgtcgaaatgggatcggctgattgctttgaaaatccaaaaacggaacaatttaaacactatctttctcactag

SEQ ID NO: 1969 - DNA, 585 bp, H. influenzae strain 86-028NP
atgtatttagatcaaatcaaagcagaacttgtagaagcacaagatgtgttaaacaaatttatttctgacgaaaataacattaaattaattcaagaagcggcattattaatttcgaatagcttcaaacaaggaggcaaagtgctttcttgtggtaatggcggttcgcactgtgatgcgatgcattttgcagaagaattaacgggtcgttatcgtgaaaatcgccctggctaccccgctattgcgatttcagatgcaagccatttaagctgtgtaagtaatgattttggctatgaatatgtcttttctcgctatgttgaagcggtggggcaaaaaggcgatgtgttattcggtttatccacttcaggcaattcaaaaaatattttaaacgctattgaagcggcaaaaacaaaaggcatgaaagtcattgcgatgacaggcaaagatggcggaaaaatggcaggattagcggatgttgaaattcgtgtaccccattttcgttatgcagatcgtattcaagaaatccatatcaaagttattcatattttaatgatgttaattgagtttgaaatggcaaaacaagcctaa

SEQ ID NO: 1970 - DNA, 915 bp, H. influenzae strain 86-028NP
atgattttttgcgatttagatcgaaaaaataagtttgagtggttggatatttttcaagatatgtttatcttgcgtaaacttattagccctttaattttcaaaaacacaatgaaattttaccgcactttgttacttttctttgctagttcttttgcttttgctaactcagatttaatgcttcttcatacctataataatcaacccatagagggttgggtaatgtctgaaaagttagatggcgtacgcggttattggaatggaaagcaattattaacccgacaagggcaacctttatcgccgccagcttatttcattaaggattttccgccttttgcgattgatggcgaattatttagtgagcgaaatcattttgaggaaatttcatcaatcacaaaatctttcaaaggtgatggttgggcaaaactgaaattgtatgtttttgatgtgcctgatgcagagggcaatttatttgagcgtttagctaaattgaaagcctatttacttgaatatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagctcacaaattttaaaattgaaaacagcacgagatgaagaatgtacggttattgcacaccataaaggcaaaggacaatttgaaaatgtgatgggggctttaacttgtaaaaatcatcggggagaatttaaaatcggttcgggttttaatttaaacgaacgagaaaatccccctccgataggatctgtgattacttataaatatcgaggcattacgaatagtggaaaacctcgatttgcaacctattggcgagagaaaaaatga

SEQ ID NO: 1971 - DNA, 984 bp, H. influenzae strain 86-028NP
atgacgaatgaagtaaaagaaaatacgccattattaaatgccattggcttaaaaaaatattaccctgtaaaaaaaggcttgtttgcaaaaccacagcaagtaaaagcgttggatggtgtctcttttcagcttgaacgaggtaaaactttagcagtcgtgggtgaatcaggttgtggaaaatcaacgctaggtcgtttattgacaatgattgaagaaccaaccaaaggcgaactttattacaaagggcataattttttagaaaatgattctgaaacaaaagcactacgtcgtaaaaaaattcaaatagtttttcaaaatccttacgcatcgttaaatccacgcaaaaagattggttcaattttggaagaaccattaatcatcaatacaaaactttccgccaaagaacggcgagaaaaagttttatcgatgatggaaaaagtgggcttgcgcgctgaattttatgatcgttatccccacatgttctcaggcggacaacgccaacgtattgccatcgctcgtggtttaatgttagatcccgatgtcgttgttgccgatgagcctgtttctgcattggatgtttccgtgcgtgcacaagtactgaatttaatgatggatttacaagatgaactaggattgtcttacgtgttcatttcacacgatctttctgtggtagaacatatcgctgatgaagtgatggtaatgtatctaggtcgttgtattgaaaaagggacgacagaacaaattttctctaatcctcagcatccttataccaaagcgttactttcagcgacaccacgtttgtcgccaaacttgcgccgtgagcgtattaagctgacaggcgaattgccaagcccaattaatccgccaaaaggctgtgcatttaatcctcgttgttggaaagcgacagaaaaatgtcgtgaaaatcaaccgcacttggaacaatatactgatggaaaattaatcgcttgtttccatattgattaa

SEQ ID NO: 1972 - DNA, 993 bp, H. influenzae strain 86-028NP
atggcattattagacgtaaaagaactttctgttcactttggcgataaaaaaacgccatttaaagcagtggatcgcattagctatcaagtcgcacaaggcgaagtgcttggcattgtgggagaatcaggttcgggtaaatctgtgagttctctcgcaattatgggattaattgatcatcctggacgtgtatctgctgaatccttgcaatttgaaaatactgatttactcactttagagagtaaagctaaacgccagcttattggtgctgatgtagcaatgattttccaagatccgatgacaagtttgaatcctgcttatactgtgggtttccaaattatggaagcgttgaaaactcacgaaggcggcacaaaaaaggcaagaaaagaccgcactttagagcttttaaaattggtcggtattcctgatcctgaatctcggattgatgtttatccccatcagctgtctggtggaatgagccagcgcgtgatgattgcgatggcaattgcttgcagacctaaattattgattgctgacgaaccaaccacggcattggacgtgactatccaagctcaaattatggaactcttacttgaattgcaaaagaaagaatgcatgtccctaattttgattactcacgatctagcacttgtggctgaagcggcagagcgaattatcgtgatgtatgctggacaaatcgttgaagaaggcaccgcaaaagatattttccgcgagccaaaacacccttacacacaagccttgttacgttcattacctgaatttgcagagggaaaatctcgcttagaatcattacaaggggtcgtccctggaaaatacgatcgcccaacaggctgtttattaaatcctcgctgcccttatgccaccgaatattgtcgccaagttgaacctcaattgcatcatatcggttcgcataaagtaaaatgccatactccgctgaacgagcaaggcaatccagttgaatatcaaggagcttaa

SEQ ID NO: 1973 - DNA, 888 bp, H. influenzae strain 86-028NP
atgtctgacacgcctttaacttttgcgccaaaaacacccttacaagaattttggttttactttaaacaaaatcgtggtgcgctaattggtttaatttttattttgattgttgccttaatcagcattctcgcaccttatattgcaccttttgatccaacagaacaaaatcgtaccgcacttttactgccacccgcttggtatgagggcggtaatcctgcttatttactcggcacagacgatattgggcgagatattctttcgcgtattatttatggaacgcgaatttccgtctttgcgggatttatcatcgtattactatcttgcgcctttggtaccagccttggcttgatttctggttattatggcggcgtgctagatacaattatcattcgcctaattgatattatgctcgcaattccaaacttacttttgacgattgttgtcgtctctattttagagccatcactcgccaatgccactttagcgatcgccgtggtatcgattcctagctatgtgcgtttaactcgagcagcgatgatgaatgaaaaaaatcgtgattatgtgacttcatctaaagtggcaggggcaggtattttacgcctcatgtttattgtgattttaccaaactgtttagcccctttaattgtgcaaatgactatgggaatatccaatgctatcttagaactcgcgacacttggtttcttaggcattggtgcaaaaccaccaacaccagaacttggcacaatgctttccgaagctcgtggttttatgcaagcggcaaactggttagttacaattcctggcttagtgattttatctttggtattagctttcaacttaatgggcgatggcttgcgtgatgcccttgatccaaaactcaaacaatag

SEQ ID NO: 1974 - DNA, 1002 bp, H. influenzae strain 86-028NP
atgtttaaatttgtattcaaacgaatcttaatggtgatccctacttttattgccattactcttattacctttgcccttgtgcattttattcccggtgatcctgtggaaattctgatgggggaacgtggcttaacggcagaagtacatcaacaaatgatgcaccaattgggtttagatttacctctttatcagcaatatttccactatattggcaatgtaattcaaggggatttcggtgcatcgttccgcactcaacaacctgtccttactgaattttttacgctttttcctgctaccgctgaattagctttttttgcgttattttggtcattattaggtggaataattttaggcacgattgccgcagtaaaaaaagacagttggatttctcacaccgttacagctgcatcgctcacaggttattctatgccgattttctggtggggtttaattttaattttatatgtttcgccacaactcggtttgccacaaggtggacgtttagataatgaattttggatcgatacaccaacaggatttatgcttattgacagctggctttctggtatgccaggtgccttcgaaaatgcggtgaaatccttaattcttcctgcaatagtcctaggcacagttcctctcgccattattacgcgtatgacacgatctgcgatgttggaagtattaggcgaagattacattcgcacggcaaaagcaaaaggtttaagctatactcgaattgttattgttcacgcattgcgtaatgcgttaattcctgttgtcactgtggtcgggttaattgtaggtcaattgctttctggtgcagttctcacagaaactattttctcttggccggggattggaaaatggattattgatgccattcaagcccgtgattatcctgtgttgcaaggttctgtactgattattgcgacgattattattgtggtaaatttaaccgtcgatttactttacggcgtggtcaatccgcgtatccgtcattaa

SEQ ID NO: 1975 - DNA, 2184 bp, H. influenzae strain 86-028NP
atgatggatatttctgaattacttgacgggcttaacgataaacaacgcaaagccgtagctgctcctcttggtaatcacctagtgctagctggtgcaggatcgggcaaaacgcgtgtattgacgcaccgtattgcttggttaattgcggtcgaaaatatttctgaaggcagcattatggcggtgacctttaccaataaagccgcagcagaaatgcgtcatcgtattcaatctacccttgccaaacacgcacaacatcaattagttggtatgtggattggcacctttcacagcattgcccatcgtttattacgagctcatcatttagatgtgggattgccacaagatttccaaattttagattcagaagatcaacttcgtttaattaaacgattattaaaattacataattttgatgaaaaagcttttccgcctaaacaggcttgttggtacatcaataacaaaaaagatgaaggcttgcgaccaaatgatattgaagattttaatgatcgccaagaacgtgaatggattaaaatttatcagatctatcaagacacttgcgatcgcgcagggttggtcgattttgctgaattattaattcgggtctatgaattatttgagaaaaaaccattaattttgcaacgttatcaacaacgttttcagcatattttggtggatgaatttcaagacaccaataaaatccaatataaatggatcaaaattctttctggaaaaacaggcaaagtcatgattgtgggcgatgatgatcaatctatatacggttggcgtggtgcacaaatagaaaatatccaaaaattcttgaaagatttcaaagccgaaacaattcgccttgaacaaaactatcgttctaccgccaatatcctaaacagcgcaaatgaattaattgcaaacaatagtgatcgtcttggtaaaaatttatggacagagggtgaaaaaggcgatcctgtgggcatctatgctgcctttaatgaattagacgaagcaaaatttgtcgcctcacaaattcaggattgggtggaacatggcggaaaacttgatgattgcgctgtactttatcgtagtaatagccaatcacgggttattgaagaagctttaattcgttgtcaaattccataccgtatttatggcggtatgcgtttcttcgaacgtcaagaaattaaagatgcgttagcctatcttcgtttgattaataatcgtcaagatgatgcggcttttgagcgtgtaattaatacgccaacccgtggcattggcgaccgcactttagatatattgcgtaacttaacacgtgaacgccaaattaccttatggcaagcagtacaagtcgcaacacaagaaaatatgttggcagggcgagcctcaacagccttattacgtttccaagaattaattaattcactacaacttgataccgcagaaatgccgcttttcgcacaaactgattttgtgattaaacattcgggcttatatgaaatgtatcaacaagaaaaaggcgaaaaaggcgaagtgcgtattgaaaatttggaagaattagttaccgcaacccgtgaatttatcaaacctgataatgcggaagaaatgaccgaactcactgcctttttaacgcacgcttccttagaagctggcgaagaacaagcctcgccgcatcaatcttgtgtagaaatgatgacgttgcactctgcgaaaggcttagaatttcctcgtgtatttatggtgggcgtagaagaaggattattcccaagttttcgttcttttgaagaacccggacgtttagaagaagagcgtcgtttagcttatgtcggtattactcgtgcgcagaaaaaactgaccatctcttatgcggaaagccgtcgattatatgccaaagaagaacgccatttgccatcacggtttatcgcagaattaccgagagaatgtatccaagaaattcgtttacgagggacagtcacgcgtgcgatgaacctagcaaaagtcggttcattgtcgaataccagtgcggtcgaaaatgaatggaaaatgggtcaaaaagttaaacacgaaaaatttggtttcggcacagtgattaatgtggaaggatctgaaaataacacacgtttacaaatagcgttccaagctcaaggcattaaatggttgattgcgcatttggcaaaattggaaaaagtgcggtag

SEQ ID NO: 1976 - DNA, 636 bp, H. influenzae strain 86-028NP
atgttgatggaaaaatatcatgattttgaaccgaactttaacatagtcgaaatttttgaaagtctgcaaggggagggcttcaatacgggaatgccaagtgtttttgtacgatttggtaaatgcaatctagactgtccttggtgtgatacaccttataataattttaaacgctggtctgtatcacaaattctagaaaaagtgcggtcattttcgtcaaagaatattatcatcacaggtggtgagccaacaattgtaccaaaaattgaatacttacttgagcaatttaaatcagatggctattttcttgcaattgaaaccaatggtctaaaagcaattcctgcacaaatagattatattgcgacgagtcctaagagcctttatgctcataagtatgaaaagcgttgcattccatttgcaaatgaagtacgtattgtaatggacagtaatatgccatcattttgtgaattgatcgagcaaaaaataaaagcaaagaattactatctttcaccttgtgaaattgatgggaaaatgaatttacttgagactatcactttacttggtcaattgaatcaacgttcaaataaacctaaatggcagctaagtttacaaacacataaattgattggtattgagtaa

SEQ ID NO: 1977 - DNA, 426 bp, H. influenzae strain 86-028NP
atgtttaaaatttccaaagaatttagctttgacatggcacatttattagatggacatgatgggaaatgtcaaaatttacatggacacacatataaattacaagttgaaatttcgggtgacttatatgaatcaggtgcaaaaaaagcaatggtcattgatttttcagatctaaagtctattgtgaaaaaagttattttagatccgatggatcacgcctttatttatgatcaaaccaatgagcgagaaagccaaattgccactctattgcaaaagttaaactcaaaaacttttggtgttccctttagaactacggcagaagaaatagctcgttttatttttaatcgtttaaaacatgatgaacaactgtccatatcatccattcgtttatgggaaaccccagcttcattttgcgagtatcaggagtaa

SEQ ID NO: 1978 - DNA, 684 bp, H. influenzae strain 86-028NP
atgaatattttcaatccaaaccacgatcgtaaagcgattgtcatcttttcaggtggacaagactccacgacttgtttattccaagctattgctgaatacggcaaagaaaacatagaagccattacctttcaatatgggcagcgtcatgctattgaattagaaaaggcgcgcgccattgtgcaagatctcggcattaaacaaaccttgattgatacatctgttatgaaagctatcacacataatgcattaatggatgaacaggcgcatattgagcaaaaagagaatgaattgccaaacacttttgttgatggtcgcaatgccctatttttactttatgcagcgatttatgcgaaaggccaaggcattcaagatattatcactggcgtatgtgaaacagatttcagcggttatccagattgccgagatgtgtttatcaagtcaatgaatgtcacattaaatttagctatggattatcaattcaatatcaaaacaccattaatgtatctcactaaagcccaaacttggcagcttgctgatgaattaggcgtattagattatgtacaaaaacatactcacacttgctatgaaggcatcgaaggtggatgcggaaaatgcccaagctgtattttacgcaataaaggtctaaagaaatatttgactcaaaaaggtagaaaaaatgtttaa

SEQ ID NO: 1979 - DNA, 144 bp, H. influenzae strain 86-028NP
atgaaaaaatggttgttgattatcgcaggcgcgttgattatttcagcttgcgcaaataaggatgtgtattttaacggtgcagaaggttcgcattcaggtgttaaatttgataaagattctcgccaatggggattgaatcaataa

SEQ ID NO: 1980 - DNA, 1032 bp, H. influenzae strain 86-028NP
atgaaagacttagactggaataaccttggttttagttatattaaaacagattaccgcttcatcgctcactggaaagatggcaaatgggacgaaggaaaactcaccacagacaatactttacatattcacgaaggttctaccgcacttcactacggccaacaatgctttgaaggcttaaaagcttaccgttgcaaagatggttcaatcaacttattccgcccgcaagcaaatgcagagcgtatgcaacgtaccgcagaccgtcttttaatgccacgcgtaccaactgaattattcgtgcgtgcatgtaaagaagtggttaaagctaaccaagattggttgggtccttacggttctggtgcaaccttatacttacgtccattcttaattggcgtgggcgaaaatatcggcgtgaaaacggcaccagagtttattttctctgttttttgttgcccagtgggtgcttacttcaaaggtggtttggctccatcaaactttatcacgactgattatgaccgtgctgcaccaatgggcactggtggtgtgaaagtgggtgggaactacgcagcaagcttacttccacacgaattagccgcagaacaaggtacgccagaacgtaaatttgcggatgcaatctatttagatccaaaaactcacactaaaattgaagaagtcggtgcggcaaacttctttgggatcacaaaagacaataaattcatcacaccaaaatcagaatctattttaccaagtatcactaaatactctcttttacatatcgcaaaagagcgtttaggtatggaagctattgaaggcgatgtgtatatcgatcaactcgatcaattcgtagaagctggtgcgtgcggtacagcggcggtgattactccagtgggcggcattcaacacaacggaaaattccacgtattctattcagaaactgaagtaggccctgttacccgtcgtctttatgatgaattaacaggcatccaattcggtgatatcgaagcacctgaaggctggattgtgaaagtagaataa

SEQ ID NO: 1981 - DNA, 894 bp, H. influenzae strain 86-028NP
atgtataaacgtttgccaccattgaattcactaaaatcttttgagtcggctgctcgttatttaagttttactaaagcagcagatgagctttgtgttacacaggcggcggttagtcatcaaattaaattattagaagaatttttagggattgaattatttaagcgaaagaatcgttctttagaattaacggagcttggtaaagcttattttgttgatattaataaaattctgcgtcgcttaaatgaagcaacagagcgattattaacgttaaaaacggatccgcatttaaatattagcgtgccacaaacttttggtatccaatggttagtgccacatttaagtgaatttaatcagctttatccgcaaattgaggttcgtttaacaggcgtggatcaagatgaaggtttgttaaataaagaaattgatcttgctatttattatggtttgggaaattggcagaatcttcaagtagatcgtctttgcgaagaaaatttattgattttagcctcacctgaattgctagcagaaaatccaattattcagcctgaagatttaaaaaaacacacattaattcacattcatacctgtgataattggcaagcgatggcaaatcatttacagttagatgatttaaatattcagcaagggccgttatttagccatacatttatggcgttacaggcggctattcacgggcaaggtattgtattagctaatcgcttattagccttgcaagaaattgaaaatggctcattgcaagcagtgttgccgactaatttgcctgatccaaaatcattttatgtggtcaatcatcttgatcgccttgatgaccaaaaaattcaagcattccgtcagtggattattaactcaattaaacaagaagaaaatgaataa

SEQ ID NO: 1982 - DNA, 1092 bp, H. influenzae strain 86-028NP
atgaataaactcgcattatattgtcgcccaggttttgagaaagaagtcgccgcagagattaccgatcaagcaagtcatttaggtgtatttggttttgctcgagtgcaagataattcgggctacgtgatttttgaatgttatcaacctgatgaggcagatcgccttgcccgagacattccttttaatcgtttgatttttgctcgtcagatgatggttatttccgatttattggaagatttagatcccgctgatcgtattagtcccatcgtggcggcatttgaagaattatcacaacaagttaattttgctcaatctagcgagctttttgtagaaactgcagacacaaatgaagcaaaggagctttccactttttgtcgtaagtttaccgtgcctttacgtcaggcattgaaaaaacaaggttggctttcggcaaaggcgagtcaaaagtgcggtcaatttttacattgtttttttgtaaaaccgaattgctgctatgtgggatattcttatgtggataatcattcctcccattttatgggaatccctcgtttaaaatttcctgcagatgcgccgagtcgatctacgttaaaactagaagaagctattttgacttttattccgcgtaaagaagagaataaacgtttaaatgaaaatatgattggcgttgatttaggggcttgccctggcggttggacgtatcaattagtcaaacgaggtttatttgtttatgcagttgatcacggaaaaatggcggcgagtttgcatgatacggggtgcattgaacattgcgcggaagatggttttaaatttcagcccccaaaaaggaaaaaagtggattggttagtctgtgatatggtggaacaaccaagtcgtatttcgttattgattggtaaatggttgttgaatggttggtgccgagaaaccatcttcaatttaaaattacccatgaaaaaacgttatcaagaagtgatattatgtttagaaaacttggctgttatgttggctgagcagaatttaaattttgatatccaagcaaaacatttatatcacgatcgtgaagaaatcacggttcatatagcattaaaaccttga

SEQ ID NO: 1983 - DNA, 1170 bp, H. influenzae strain 86-028NP
atgaatttacacgaataccaagcaaaacaactatttgagcattatggattacccgtaaaaaatggggcagtctgtcaatctgttgaggatgtcgatttggtactggctcaactttcaggcgataagtgggcggcgaaatgccaagttcatgctggtgggcgtggtaaagcgggtggcgttaaattggtacaggatgtagaggaagcgagagcttttgcagaaaaatggctgggacaacgtttagtcacttttcaaacggataaattgggtcagccagtaaaccagatttattttgaagaaacttgcgatattgataaagaattttacttaagtgcggttgttgatcgtgcctctcaaaaagttatgtttattgcttctcctgctggtggaatgaatattgaagaagtcgcgcaaaattcactgcacttactccataaagtcgagattgatcctttatttggaggattgccttatcaaggccgtgaattggcgtttaaattagggttaagtggtacgcaaaacaaacagtttaccgatatctttatgggcttatctcgtttgtttttagaaaaagatttatctttagtggaagtcaatccacttgttctaactaaacaaggctatttggtttgtctcgacgccaaaatatctgtcgatgataacgctttatttcgccataaagatctcttagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgaaagagcgggttgctgaagcgttcaaaatcattttaaccgatccttccgttaaagtgattttagtgaatatttttggtggcattgttcgttgtgatttgattgctgaaggcgtgattgctgcagtaaatgaagtgggcgtgagagtgcctgtggttgtgcgattagaaggaacgaatgctgaaatgggtcgccaaattttagcgcaaagcgacgttaatattcttacagcacagagtttacaacaagctgcagaattagctgtgaatgcagcaaaaggagaacactaa

SEQ ID NO: 1984 - DNA, 882 bp, H. influenzae strain 86-028NP
atggcgattttaattgataaaaatactaaagtgatttgccaaggttttactggtggacaaggggcttttcattccgaacaagcattagcctacggaacgcaattagttggtggcgtatcgccaaataaaggtggaaccactcatcttggtttacctgtatttaatacagttcgtgaagctgtcgaaaatacgggggcaacagcgacagttatttatgtgccagcatcattttgtaaagatgccataattgaagccattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgttactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaa

SEQ ID NO: 1985 - DNA, 624 bp, H. influenzae strain 86-028NP
atgagccaatttttctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaacggtaaataataccgcttatcgtttgattaaaaataatacgccagggcgttatacttttattcttacagcaacgaaagaattacctcgccgtttaatgacatcaaaacgtaaaaccattggtttacgcgtaccagataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaa

SEQ ID NO: 1986 - DNA, 1074 bp, H. influenzae strain 86-028NP
atgaaacctagtcaaaaacaaactcaaagacaaccgcacttttccaaagattcagcaaagaaacgtgatttttcagctaaaaatgacagacgttcagtatctcgtactgctcgcatagaaacagcaaatacgaaaaaaagtgcggttaattctgacaacaaatttttatctaagccaaaagcgaaacctgttgtaagagcctcgaatcaaccgaaagcagagggcgaaaaattacagaaagttttagcgcgtgctggacaaggctctcgtcgtgaaattgaaacgatgattgccgcaggcagagtgagcgtagagggtaaaattgcgactttaggcgatcgtattgacgtacattctggcgtgaaagtgcgtattgatggtcaaatcattaatcttagccacgcacaaaaagaaatttgccgtgtattaatgtattacaaacctgaaggcgaactctgtacacgtagcgacccagaagggcgtgcgaccgtgtttgatcgtttgccgcgtttaacgggatctcgttggattgcggtggggcgtttagatattaatacatcaggtttattgctttttaccactgatggcgaattagcaaatcgtttaatgcacccaagccgtgaagttgaacgtgaatattctgtgcgtgtatttggtcaagttgatgatgcgatgttagcgcgtttacgtaaaggcgttcagcttgaagatggtcctgctaattttaaagaaattaaatttacaggcggtgtgggtattaaccaatggtatgacgtaaccttgatggaaggacgtaaccgtgaggttcgtcgtttgtgggaatctcaagggattcaagttagccgcttgattcgtattcgttatggaaatatcaaactgatgaaaggtttgcctcgtggtggctgggaagaaatggatcttgaaaacgtcaattatttacgtgaattggtgggattacctgctgagactgaaacgaaattagatgtaaaacaggctagtcgtcgtccaaaatctgggcaaattcgtaaagcggtaaaacgttattcggagatgaacaaacgttataaaaaataa

SEQ ID NO: 1987 - DNA, 972 bp, H. influenzae strain 86-028NP
atgaaaatgcatcaattgcgttatatcgttgagattgtaaaccaaaatttgaatgtcacagaagcggcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggcacgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcgcatacggcattagatgcggatcttgtgctaattgatgcaagccatttgttccgcccgagtatgacgaatattgcatttaaacatagcacgttcttacgtaattatatgtacgattttatggaatatttttcaccgcacttaattcgtagtgtcgtagaaaaagccgagcgtttgcgtgataacaattcagtgaaaaaattatttgaaggcattgaattggaaacaagataa

SEQ ID NO: 1988 - DNA, 945 bp, H. influenzae strain 86-028NP
atggaaacttcacataaccaagaattagttgcaactatcttggaagataatgttgcaaacgaactgcaaaccatccaagattttctgcgttggacgtatagcattctcaatcgttctgatatttacttcgggcaagggcacgataatccttgggatgaaagcctgcaactcgttttaagtggcttacatttacccattgatttacctaccgaattatttaacagtcgattaaccccatctgaaaaagaaaccttagttcaacttgtattaacccgaatcgaacaacgcatacctgtggcatatttaacgaatagcgcttggttctgcggtcacgaattttatgtcgatgaacgaaccattattccacgttctccaattagtgctttaattcaagatcgctttgaagatttaatttcacaagaaccaaatcatattctcgatctatgcacaggcagcggttgtattgccattgcttgtgcttatgctttcccgaatgcggaagtagatgcggtagatttatcggttgatgcacttaatgtcgcagagatcaatatttcacgccatcaattagagcatcgtgtattcccgattcaatcaaacttatttgaaaatattttgggacagaaatacgatcttatcgtgaccaatccaccttatgtggatgaagaagatctcgccgatatgccagaagaattccattttgaaccagagttagccttaggttctggcagtgatggcttaaacattaccaaacaaattttgaaacaagcaccagattacttaaccgaaaatggcgtgttggtgtgtgaagtgggtaatagtatgattagcttaattgagcaatatccagatgtaccatttgaatgggtagaacttaaaaatggcggactaggcgtatttgctattcagcgtaaagatttagtgaaatatcacgatctgttttaa

SEQ ID NO: 1989 - DNA, 504 bp, H. influenzae strain 86-028NP
atgcaagacgaatttgatttattccgtgcggaaaccaaaggcattaagccaatgaaacaagatacttttgttgcccctcaccaaaaacgtgatcagaaaaaaatagaattgaaagaattacgagcgaaagaagatacgttattttatttttctgatgaatatgagccgttactgaatgagcatgatggtgttgtgaaatatttacgtgatggggaagattcccatttattaaaacaacttcgtcgtggagatttttcgccagaattgtttttagatttacacggtttaacccgtgaacaagctaagcaagaattagccgcacttttactggcttgtgaaaatgagcatattgattgtgccagtatcatgacgggctatggcacctttacattgaaaaaacaaattccacgttggctagtacaacatcctaaagtgcgggcattgcatcaagcgccaagagaatggggcggtgaagccgcaattttgattttggttgatttgtaa

SEQ ID NO: 1990 - DNA, 2136 bp, H. influenzae strain 86-028NP
atgtctcgcacgattattcttatccctgtaagtacaggcgtgggtttaactagcattagtcttggattaatccactctctcgaacaaaaaggcacaaaagttgcttttatgaaacccgtttctcaaccaagcactggcgaagataaattggatcgcacaacctctattattcgcactagcactagccttgaaactgccgaaccctttatgttaagcgtggcagaatcattaattggtcaaaatcagtctgacgtattgttagaaaaaattgtagctaaccaccaacaattaaccaaaaacaacgatatcgttgtggtggaaggtttaattccaacaagaaaacacggttatgcaaataatatcaactatgaaattgcacaagcattagatgcagaaatcgtattagttgcagcaccagcaactgaaaccccaaccgaattaaaagatcgtgtagaagcagcagcctctttatttggtggtaaaaacaatccaaatcttttaggcgtagttgtaaacaaattcaatgcacctgttgatgaatctggtcgtacacgccccgatcttgctgaaatctttgattcattccaacacaatcatattagcgaaacagaagtaaacaaattatttgcaggtagtgccatcaagttattagcttgtgtgccttggaatgcaaatttaatcgctacacgagcaatcgacttagtcaaacatttaggtgcatcaatcattaatgaaggggaaatcaatcgccgtattcgtggtatcactttctgcgcaagaagtttaccaaatatggttgagcatttccgtgcaggcagtttattagtcgcttcagcagatcgtccagatgtgcttgtagcagccgctctcgcagcgtcaaatggtattgaaatcggcggtattttattaacaggcggttataaaattgatgctcaaattaataaactttgccaacctacttttgaaaaagcaaaattgccgatcttccgtattgaaggcaatacttggcaaacggcattaagtttacaaagctttaatcttgaagtgcctgttgatgacaaagaacgtattgagaatattaaacaatacattagccaacactttaatgctgactttatcaataatttagttgcagattctagccgtttacctcgcttatccccacctgcattccgtttccaattaactgaacttgctcgtgcggcgaaaaaacgtattgtgcttcctgaaggcgatgaacctcgtacaatcaaagcagccgtactttgcgcagaacgtggcattgcggaatgtgtgcttttagcagatcctgcatccgttcaacgtgttgcagaagcacaaggtgttaaattaggtaaaggcattacaatcattaacccagcagatgttcgagaaaactatgttgatcgtttagttgaattacgtaaagcgaaaggcatgaccgaaaccgcagcacgtgaacaattagaagataccgtagtgcttggtactatgatgttagaagcaaatgaagtagatggtttagtatctggtgccgttcacacgactgcaaacaccattcgcccaccaatgcagatcatcaaaactgcaccaggtagttcaatcgtttcttctatcttctttatgttattaccagatcaagtacttgtttacggtgactgtgcggtaaacccagatccaactgcagaacaacttgcggaaatcgcaattcaatctgcggattctgcgaaagcatttggtattgatccaaaagtcgcaatgatctcttactcaacaggtacatctggtagcggtgctgatgtggaaaaagtgaaagaagcaacccgtattgcgaaagaaaaacgccctgatttattaatcgatggcccattacaatacgatgcagctgtgatggaagacgtggctcgctctaaagcaccaaattcaccagtagcaggtaaagcaacagtattcgtattccctgacttaaatacgggtaacaccacttacaaagcagtacaacgttctgcagatttagtgtctattggcccaatgcttcaaggtatgcgtaaaccagtcaatgacttgtctcgcggtgccttagttgatgatattgtatacacaattgccttaaccgcaattcaagcaacacaatag

SEQ ID NO: 1991 - DNA, 1206 bp, H. influenzae strain 86-028NP
atgtcaaaacttgttcttatccttaactgcggtagttcttcactaaaatttgcaattcttgatccagcaacaggggaagaaaaattatctggcttagccgaagcatttttcttaccagaagcacgtatcaaatggaaactcaatggagagaaaggtaacgcagatttaggcgcaggcgcagcgcatactgaagcgcttaattttattgcatctaacattctgactgatgaactaaaaaattctatcgcagcaattggtcaccgtatcgttcacggtggcgaaaaatacacccaatctgttatcgtaactgatgaagttgttaaaggtattgaagatgctgcacaatttgcgccacttcacaatccagctcacttaattggtattcgcgaagcatttaacgcattcccacacttaaaagataaaaacgtggtagtttttgatacagcattccaccaaactatgtctgaagaagcattcctttatgcccttccatactctttatataaagaacacggcgtacgtcgctatggtgcacacggcacaagtcactacttcatttctcgtgaagtcgctgaatatgtaggcaaacccgcagaccaagtcaatgctattatttgtcacttaggtaatggtggttctgtttctgttgtgcgtaacggtcaatgtatcgatacgtcaatgggtttaactccactagaaggtttggtaatgggtacgcgttgtggcgatattgaccctgcaatcgtattctatctatacaaaacactaggtatgtctatggaacaaatcgaagagactttagtgaaaaaatctggtcttttaggtttaactgaagtaaccagcgactgccgttatgctgaagataactacgataatgcatctaaaccagaagcaaaacgcgctttaaatgtttatagctatcgtttagcgaaatacattggtgcttatatggctgtgttgggcgatgatcacttagatgcgattgcattcactggtggtattggcgaaaactcagcgcacgttcgtgaattagcattgaatcacttaaaattatttggcattaaaattgataatgaacgaaatcttgccgcacgttttggtaaagatggcgtaatcacgactgatgattccgcatttaaagcgattgttcttccaactaacgaagaattggttatcgcacaagataccgcaagactttgtttctaa

SEQ ID NO: 1992 - DNA, 444 bp, H. influenzae strain 86-028NP
atggcgtttttttccatttttaaacagggacaaatttatcttaatacttggccgcaggaggcgaagttagggattattttccctgaaaaccgtattatgaaagccacgagttttgcacaaaaatttatgccttttgttgctgtatttgcaatactgtggcaacagatttatgcaaaaaatgatttaatggcattttctatcgcaattttgaccgcactttttgccttgcttattccttttcaagggctttattggcttggtaagcgtgcaaattcgccattagaaaatcaaagtgcggtatggttttacgatatttgcgaacgcttaaaacaacaaaatgaacccttgccttttgtgcaagaaaaaccgacatatcaacatttagcggaagtcttaaggaaagctcaaagcaaatttgaacgtgctttttggcaggaaatttag

SEQ ID NO: 1993 - DNA, 492 bp, H. influenzae strain 86-028NP
atgatcgattacattattattggcattatcgctttttccattcttgtcagcttattacgtggttttgtacgcgaagtactttcacttggtagctgggttgtggcatttatcgtagcaagccagttctatccttatcttgccacttatcttacgcaaattgaatcaatgtatgtgcgtaatggaactgcaatcgccattctgtttgttctgactttaatcgtgggcgcaatagtaaattatgtgattagtcaattagtagataagacgggtttaagcggcactgatcgcgtattaggtgctgctttcggtttagtgcgcggtgcattgattgtggctgcgttgttattttttatggatacttttaccaattttgaacaaactgattggtggaaagaatctcaattaataccgcattttggttttattattgaatggttctttcaacagcttcagtcaagttcaagttttttaaatccaacgcttaatcaataa

SEQ ID NO: 1994 - DNA, 1518 bp, H. influenzae strain 86-028NP
atgtgtggtattgtcggtattgttagccaaagtccggttaatgaatctatttatgcagcattaactcttttgcaacatcgtggacaagatgcggcgggtattgtaacggttgatgatgaaaaccgtttccgcttacgtaaagctaatggcttagtcagcgatgtgttccgtcaagagcatatgctacgcttgcaaggaaatgctggattagggcatattcgctatcctacggcaggaagttctagcgtctcagaggcacaacctttttatgtaaattctccctatggtgtcactttggtgcataacggcaatttaaccaactcagtggagttaaaagaaaaagtctttaaaactgcccgccgtcacgtaaacactaattcagattctgaacttcttcttaatattctcgctaatcatcttgatcacattcctcaaaaccatcttgatccacaagatattttctatgctgttcgtaaaactcacaatgatattcgtggtgcttatgcctgcgtagcgatgattattggacacggaatggttgcatttagagatccttttggtattcgtcctttggtgttgggtaaacgtgaagaaaatggcaaaactgattatatgttcgcctctgaaacagtagctttagatattgtgggtttcgagtttgtgcgtgatattgctgcgggcgaagccgtttatgtgacatttgatggcgagctttattcacaacaatgtaccgaaagtgcggtgttaaatccttgtatttttgagtatgtttattttgcacgcccagattcaacgattgatggtgtctctgtttatgcggcacgtgttcatatgggggaaaaactcgggaaaaaaattgcaaaagaatgggcggatgaaattgataatattgatgtggtcattcctattcctgaaacctccacagatattgcgttacaaatagctcgtgttctagggaagccttatcgacaaggatttgtgaaaaatcgctatgttggtcgtacctttattatgccaggtcaagcacagcgtattagttctgttcgtcgcaaattgaataccattaaagctgaatttaaagataaaaatgtgttattggtggacgattctatcgttcgtggcacaacctctgagcaaattgttgaaatggctcgctcagctggtgcgaagaaaatttactttgcctctgcagctcctgaaattcgttatccgaatgtatatggtattgatatgccgagttgtgatgaactgatcgcttacggtcgaaatgttgaggaaattgcacatttgatcggcgtagataaattaattttccaagatctgaccgcacttactgaatctgttcaattggaaaatccagccattcaaggttttgattgttcagtattcacaggcgaatatattacaggcgatattagtcctgaatatcttgataaaatcgcacttcaacgcaacgatagtgcaaagaaaaaacgtgaaaaacaagcatccaatcttgaaatttataatgaacaataa

SEQ ID NO: 1995 - DNA, 891 bp, H. influenzae strain 86-028NP
atgaatattttattaacaggaggcacagggcttatcggcaaagcacttgttgaacaactttgcttacgtaatgaacaagtgacgatcttaacgcgctcaagttcgccgcacactctctcaaagcaaaaaaacatcaaatttattaccgcactttcagaactcgatttacaagaacagtttgatgccatcatcaatcttgctggcgaaccaatttttcataaagtttggtcgaaaaaccagaaatctattttacgagaaagtcgtttaagcctcactactcaactggttgaattcatcaatcagtatcagcaatacccaatttttatatcaggttcagcaactggaatttacggcgatcaaggcgaacaaaaaattaccgaaacaagcaaaacagcaaaaacctttaccgcacaattatgccaagattgggaaaatatcgctcaacaagctaatgcgagagtttgtttgattcgaacaggcatggtcttttctacaaaaggtggcgcacttgctaaaatgttgcctttatacaaatggggacttggcggtaaactgggcaatggagagcaatatttcccttggattgctttggaagatatggtaaacggcattttatttttactcgaccattcagaatgccaaggatcatttaacttcaccgccccgaatcccataaaacagcataaatttaaccgcactttggctggaatattaaaacgtcctgcctttgcaactattccaaaatggatattacatttcattcttggcgaacgagcgaatctattactagaaagccaaaatgttgtgcctgaaaaattactcaacgctggattccaatttcagtattctgattgcaaaaactatctagaagaaatcctaaaaaacaaataa

SEQ ID NO: 1996 - DNA, 456 bp, H. influenzae strain 86-028NP; identical to SEQ ID NO: 647

SEQ ID NO: 1997 - DNA, 936 bp, H. influenzae strain 86-028NP
atgaaagttgctgtattaggtgccgcaggtggtattggtcaagcattagcgttattactaaaacttcagttgccagcaggcaccgacttagcattatatgatattgccccagtaacaccaggtgttgcagtagatgtgagccatattccaacagcagtgaatgtaaaaggtttttctggcgaagatccaactcctgcacttgaaggtgcggatgttgtattaatttctgctggtgttgcacgtaaacctggtatggatcgttcagatttattcaatattaatgcaggtatcgtgcgtggtttaattgagaaagtcgcgattacttgcccaaaagcttgtgttggtatcatcactaacccagtaaatactactgttgcgattgcggctgaagtgttgaaaaaagcaggcgtttatgacaaacgtaaattatttggtgtgacaactttagacgtgttacgttctgaaacttttgtggctgaattaaaaggtttaaatgtttctcgtaccagcgttcctgttattggtggtcactcaggtgtgactattcttccattactttctcaagttcaatatgcaaaatggaatgaagatgaaatcgaaccattagcaaaacgtatccaaaatgcaggtacagaagtggtcaatgcaaaagcaggtggcggttctgcaacgctttcaatggcgcaagctgcggcacgttttgctcgttctttagtgaaaggattaagtggcgagacagtggttgaatgtacttatgttgaaggcgatggcaaatatgctcgtttcttctctcaacccgttcgtttaggcaaagagggtgtagaagaaattttaccaattggcccattaagcaattttgaacaacaagctttagaaaatatgttgccaactttacgtgcagatattgaattaggcgaaaaatttattaatggttaa

SEQ ID NO: 1998 - DNA, 1509 bp, H. influenzae strain 86-028NP
atgtcagaacaagaagttaaagaattagatctcaatggcgaaatgctcgtccgtcgtgaaaaattagccgcattgcgtgcaaaaggtaatgcctttccgaataaattccgtcgtgatgcgctcgcacaagatttgcacaatcaatatgattcagaagacggggaaatcttaaaagagaaaagcattgaagtacaagttgctggtcgtattatgactcgccgtgcaatgggtaaagcaacgtttatcactattcaagatatgagcagtaaaatccagctttatgttgcacgcgataatttgcctgaaggtgtttataaagatgacgttggtacttgggatttaggcgacatcgttggcgttaaaggcactttatttaaaacaaaaaccgatgaacttaccgttaaaaccactgaggttcaacttttaactaaagcacttcgcccattaccagataaattccacggtttaaccgaccaagaagttcgttatcgccaacgttatttagatttaatttctaacgaagaatctcgccgcacttttattattcgttctaaagttgtcgcggggattcgtgaatatttcatttctaaaggctttatggaagtggaaacgccaatgttacaagtcattccaggcggtgcatctgcgcgtcctttcgtaactcatcacaatgcattagatgtggatatgtatttacgtatcgcacctgaactttatttaaaacgcttagtcgttggtgggtttgaacgagtatttgaattaaaccgtaacttccgtaatgaaggggtttctgttcgtcataatccagaatttactatgcttgaatattatcaagcctatgcggattaccatgatttaatggataacaccgaagaactgcttcgtaaattagcgattgatattcttggtactactattgtgaaatacggcgaatacgaatttgattttggtaaaccattcgaacgtattacgttacacgatgcaacggttaaatatggtgcagacaaaggtatcgtaaaagaagatttatatgactttgatcgtgcaaaagccacggcagaacgcttaggtattgaagtacaaaaatcttggggtttaggcagcattgtcaatgcaatttttgaagaagtggctgaacatcacttaattcaaccaacattcttaatggctcatcctgcggaaatttctccacttgcacgtcgtaatgatgaaaatccagatgtaacagatcgttttgagctctttatcggtggtcgtgaaatcggtaatggtttctcagaattaaatgacgcagaagatcaaaatgaacgttttgatgcacaagtggctgcaaaagaagctggcgatgatgaagcgatgtttaaagatgaagactttgttgttgcattagagcacggcttaccaccaacagctggggaaggtttaggtatcgaccgcctagcaatgctttatgcaaatgcaccatcaattcgtgatgtgatcttattccctgcaatgcgtcagaaataa

SEQ ID NO: 1999 - DNA, 852 bp, H. influenzae strain 86-028NP
ttgttagaactcgccatcgaggcagaagacgaagacactttcaatgaagcggttgctgaattagatgaacttgaacaacaactcgaaaaattagagttccgtcgaatgtttagtggcgaacatgatgcttgcgattgctatgtggacttacaagctggttctggcggtacggaagctcaagattggacagaaatgttgctgcgtatgtatcttcgttgggctgaaagcaaaggttttaaaacagaactgatggaagtctctgacggtgatgtagctggattgaaatcggcaaccattaaagtgagcggagaatatgcttttggttggttacgaacagaaacgggcattcatcgtttagtgcgtaaaagtccatttgattccaataaccgtcgtcacacatcattcagcgcggcatttgtctatcctgaaattgatgatgatattgatattgaaatcaatcctgctgatttacgtattgatgtttatcgagcatcgggagctggtgggcagcacgtaaacaaaactgaaagtgcggtgcgaattacccatatgccaagtggtattgtggtgcaatgtcaaaatgaccgttcacagcacaagaacaaagatcaagcgatgaaacaattaaaagcgaaattgtatgagcttgaattacagaagaaaaatgcggataaacaagcaatggaagataataaatctgacattggttggggaagccaaattcgctcttacgtattagacgattcacgcattaaagatttacgtactggcgtggaaaaccgtaatacgcaagccgtattagacggggatttagatcgatttattgaagcgagtttaaaagctgggctttaa

SEQ ID NO: 2000 - DNA, 690 bp, H. influenzae strain 86-028NP
atgaagaaaatttttaccgcacttttgtgcgtggctgcggctaatgcaatggcagatgatgcggcaattaaacgcaaattacagtcttttaatgtgtcaaatattgctattaaatcttcgccgatttcaggcattagaacggctgtcacggatcaaggtatactttatgtgagcgaagatggaaaatatctttttgaaggtaaactttatgaactcacaaataatggccctgttgatgtagcaggtaaaattttagtagataaacttaattcttataaagacgagatgattgtttatcctgcgaaaaatgaaaaacacgtagtaacagtatttatggatattacctgccattattgccatttgttacatcagcaattaaaagaatataacgatcttggtattactgtgcgttatttagctttccctcgtgcaggtatgaataatcaaacggcgaaacaaatggaagcgatttggacggcgaaagatcctgtttttgctttaaacgaagctgaaaaaggcaatttaccgaaagaagttaaaacgccaaatatcgtgaaaaaacattatgaattaggtattcaatttagtgtacgaggaacaccaagtattgttacctcaactggtgagcttattggcggttatttaaaaccagctgatttattaagagctcttgaagaaacggcacaataa

SEQ ID NO: 2001 - DNA, 1728 bp, H. influenzae strain 86-028NP
gtgaaaaaacttatcaaacgccgtgaaattccagttggaaattctgtttcaaaccatcccttattagatcgcctttatcgtgctcgtcatattaaaaacaccaaagaattagaccgcactttgaaatcaatgctcaatccaaatcaattatatggcattgatcaagctgtaaatttattagttgaagcctatcaacaacagcaaaaaattgtgattgttggggattttgatgctgacggtgcaaccagcacagcattgagtgtgctggctttaagacaacttggcttttctgatgtggattaccttgtgccaaatcgatttgaacaaggttatggcttgagtattcctgtggctgaaatggcgattgaaaagggcgttcagcttttaatgacggtggataatggcgtttcgtcttttgacggtgtggcatttttgaaagaaaaaggcattcgagttttagtcacggatcatcatttaccccccgaaactttgccgccagccgatgctattgttaatcctaatttaagtcagtgtcatttcccttcaaaatccttggcaggtgtgggtgtggcattttatttgatgttagccgtacgagcaaaatttcgtgaactcggtatttttacggcagaaacacaacctaattttactgatttgctcgatctggtggcactaggcactatagctgatgttgtgcctttagatcaaaataatcgtatccttgcttatcaaggtttaatgcggattcgtgcacggcgttgccgtcccggtattgttgcgttggcagaagtggctaaccgtaacgtagagcagtttacttcaagtgatctcggtttttgtattgggccgcgtttaaatgcagcagggcgtttagataatatgtcgattggggtagagcttttgctggcgaacgaaatgtcaaaagctagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaacctgattggcatcaaggcgtattaggcattgtatcatcaaggattaaggatcaatatcatcgtccagtgattgcctttgcacaagatagtgagggaattttgaaaggttctgctcgttctattgaaggtttacatatgcgtgatgttctggagcgtattcattcgcaacatcctaatatgattttaaaatttggcggacacgcaatggcggcaggcttgagtattcgcgaagaacattttgccgatttccaacatatttttaatcaaaccgttgccgattggcttgatgaagaacatatgcaaagcataatttggacagatggcgaactaaattcaaatgaatttaatcttgaaacggcagagctgataaaatcggtaggcacttgggggcaagagtttcctgagccttgctttgatggcgaatttaaaattttagaccagcgcgcaattgggcaaaataaaaatcatctaaaaatgttgctagaaccgaaacaaggcggggttttattagatgcgattgcatttaatattaatacaagattgtatcctgatctttcaattaaacaggctcgtttagcctataaattagatattaacgaatttcgtggcaatcgtagcctacaattattggtagattatattgagccgatagatgagtga

SEQ ID NO: 2002 - DNA, 708 bp, H. influenzae strain 86-028NP
atgagtgatagaatgaaattaaagggaatattggcattttgtttgctttttttatcgtcgtttgttttagcagaagtcaatcagaaagaattttcagtgcaaaattctccgcacttgccatcaagggacacaatctattttgaagacgggcgtgattatttttcttataaagaacctattgaacaagtgtctcgagcggataaaaaaatccgcattcaattcttttttgattatgattgtcgagtgtgttcttcagcgcaggatattttagaactttatagccaaatacgcacatataaagttgtgttggaacaatatcctattgcaactgccgatagccagtttagcgcacgtattttttatactttgcaagcattaagtgcgagcgaattatccaatgttttgttatttgaaacttcagaaaaatcccgttatacagaattgtccacatcaaataaaattcagcaatgggcggaagaacaagggctagataagcagttatttattcaaactgaaaattcacaaagcgtaaaagaacagatccaaaatgcgattgaattgacggaagaatatggtgtttttacctatccttacgttgttatcggtggaaaatatgtactcactgcaagtacgctttataacgatgattatagcgtagcagtgttagattttttggtaaataaaatagaacaggaacaaaaacaatga

SEQ ID NO: 2003 - DNA, 693 bp, H. influenzae strain 86-028NP
atgaaaataggaattgttggtgcaatggcacaagaagtcgaaattttaaaaaatttaatggctgatagaacggaaactcgagtagcaagtgcggtcatttttgaaggcaaaattaatggtaaagatattgcattattgcaatcaggcattggcaaagtggcagctgcaattggcacgacggcgttattgcaattagccaagccagattgtgtgatcaatactggttctgcaggtggggtagcaaaaggcttgaaagtgggggatattgtgatttctgatgaaacacgctatcacgatgcggatgtgacagcttttggctatgaaaaagggcagttgcctgctaatcctgctgcatttttatcggataaaaaattggcagatctcgctcaagaaatggcagaaaagcaagggcaatcagtaaaacgtggtttaatttgttctggcgatagttttattaatagcgaagacaaaattgcacaaattcaagcagatttcccgaatgtaatgggcgttgaaatggaagccacagcgattgcacaagtttgttatgcttttaatgtgccttttgtggtggttcgtgctatttctgatggcggcgatggcaaagcaagtatgtcttttgaagagtttttaccattggcggcgaagcagtcttcggcattagtattagggatgattgacagactgtcgtaa

SEQ ID NO: 2004 - DNA, 2748 bp, H. influenzae strain 86-028NP
atgaagaaagctataaaattaaatttaattacacttggcctaattaatacaatcggtatgacgattacacaagctcaagccgaagaaacattaggacaaattgatgtagtggaaaaagttatatcaaacgataaaaaacctttcactgaagccaaagccaaaagtacacgtgaaaatgtctttaaggaaacacaaaccattgaccaagtgattcggagcattcctggggcatttactcaacaagataaaggctcgggtgtcgtttctgtaaatattcgtggcgaaaatggattaggtcgtgtcaatacgatggttgatggtgtaacccaaaccttctattctacagccttagactctggtcaatcaggcggaagttctcaatttggtgcggcaatcgatcctaattttattgcaggtgtagatgttaataaaagtaacttttcgggagcaagcggtataaatgcgttagcaggcagtgctaattttagaacattaggcgttaatgatgttattaccgatgacaaaccatttggcattattctgaaaggaatgacaggaagcaatgccactaaatccaattttatgacgatggctgctggcagaaaatggcttgataatggtggctatgtaggcgtggtgtatggttatagccaacgtgaagtttcacaagattaccgtattggaggcggagaacgattagcatcattagggcaagatattctcgcgaaagaaaaagaagcttattttcgtaatgcgggttatgttttaaatgatgctggacagtggactcctgatctaagtaagaacgcttggtcttgtaacgaagaccctcctcgtttagcagagaatatagagaatgttaaatgtacacattattcttttgatcctagaaaaaacgatagaaaagaaattctcaaaaaattaaaagctggaacaaaacctgagaatattgacgagctccaaaacggtaaggatggaattaaagaaactgacaaatcatttgaacgtaataaagatcaatatagtgttgcaccaattgagcctggtagtttgcaatcacgctcgcgtagccatttattaaaatttgaatatggcgatgatcaccaaaatttaggagcacaaatacgtacattggataataaaattggttctcgcaaaattgaaaaccgtaattaccaagtcaattataacttcaataataacaactatctcgatcttaatttaatggctgcacataacattggtaaaaccatttatcctaagggtggtttttttgctggctggcgagtggcagacaaacttattaccaaaaatgtggcaaatattgttgatataaacaacagccatactttcttgttgccaaaagaaatcgatttaaaaaccacattaggttttaactattttaccaatgaatacagtaaaaaccgttttccagaagaattaagtttgttttataacgatgattcacatgatcaaggtaactatagtaatttaggacgatttagaggtaatcgtaatttactgccacaacgttcagtgattttacaaccttctggcaagcaaaaatttaaaacggtgtattttgataccgcactttctaaaggtatttaccatttaaattacagcgtgaattttacccattatgcgtttaatggtgagtatgttggatatgaaaatacagcgaatcaaattaatgaaccgattttgcataaatcagggcataaaaaggcattcaatcattccgctacattaagtgcagagctaagcgattattttatgccatttttcacttattcacgcacacacagaatgccgaatattcaagagatgtttttctctcaagtgtctaatgcaggggtaaacacggcattaaaacctgaacaatctgatacctatcaactaggctttaatacttataaaaaaggtctcttcactcaagacgatgtgctaggcatcaaattagtgggttatcgtagctttattaaaaactatatccataatgtttacggtgtttggtggcgagatggcgttgtacctacgtgggcagacagtactggttttcgctttactatcgcacatcaaaattatcaacctatcgtgaaaaaaagcggggcggagttagagcttaattatgatatgggacgtttttttgcgaatgtctcttacgcttatcaacgtactaatcagccaaccaattatgccgatgccagctcacgtccgaataatgcttcaaaagaagacattttgaaacaaggttatggcttatctcgtgtttcaatgctaccaaaagactacggcagattagagattggtacacgttggtttgatcaaaaattaaccttaggtatggcagctcgttattatggaaaaagtaaacgtgcgacaattgaagaagaatatatcaatggatctcactttgaattaaagacctcaggtaaaagaacttactacgttgtgaaaaaaacagaagagattaaaaaacaaccgattattttagatttacacgtcagctatgaaccaatcaaagatttgattattaaagcggaagtacaaaatctattagataaacgttatgttgatccgttagatgctggaaatgatgcggcttcgcaacgttattattcaagtttaaatgattcaatttgtagtaaaagtcaggattgtgaagatggaggaaaagataaaaccgtgctttataactttgcacgtggaagaacttatattctgagtttaaactataaattctaa

SEQ ID NO: 2005 - DNA, 1599 bp, H. influenzae strain 86-028NP
atgctgtcttttattctaagtatttttcctatcgttttactgatttatcttatggtaaaaagaaacgcgctaccttcttatgttgccttaccttggattgcgacattagttatgggtgttcatcttttacactttaatacagatattgtcactattagtgcaaatgttgtttctgcaattattgcggtacaaacacctattacagtaatttttggtgcgattctctttaaccgtttctctgaaatttcaggcgcaacaaatattatgcgaaaatggctaggaaatattaatccaaatcccgttgcacaattaatgattattggttgggcgtttgcttttatgatcgagggagcaagtggttttggtacaccagcggcaattgctgcacctattttagtgggattaggttttcatccattaaaagtggcgatgttggcacttattatgaactcagttcccgtatcctttggtgcggtaggtacaccaacttggtttggttttggtgctttaaaattatcagaagatatgattttagaaattgggtctattacagcatttatacactccattgctgcacttattatcccattattagcacttcgtatcttagtaaattgggatgatattcgtaaaaacatcgtatttatctatattagcgtactgggttgcgtagtaccttatttcttgattgctcaagtcaattacgaatttccatcactcgttgggggggcaatcggcttatttatttctgtatgggctgctaatcgcaatattggtttagcaaaagtaacaaatacccttgataataatgcggtaagtacgggagaagtagttaaagcattattccctacaggtttacttattgcatttttaattgtgactcgtattcatcaattaccattcaaagcaatgatgaatgatgcaactatttggttctcaaccacattaggttcgttaggattatttgaaattagcaaaggtttaatctttagcttaaaaaatatttttggctcaaatgtttcatcaagctataaacttctttacgtacccgcattgattccatttgtcattacagtactaattgcgattcctgtctttaaaatttccagttcaaatgttaaacagatttttgtatcaagtttacaacaatctaaaaatccatttattgccttagttggtgccttagtgatggtaaacctaatgttagtgggtggcgaacattctatggtaaaaattataggtagaacttttgctgaaatttctggtagtaactggactattttctcctctttcttaggcgcgattggatcctttttctcaggttcaaataccgtatctaacctaacatttggtagtgttcaactttctaccgcagaaacaacaggcatttctgtcgcacttgttcttgctttacaatctgttggtggggcaatggggaatatggtatgtataaataacattgtagcggtaagttcagtgttaaatatttcaaaccaagaaggcacaattattaagaaaaccattatacctatgatcatttacggtatcattgccgcacttggcgcgctattcttagtacctttattttataatctataa

SEQ ID NO: 2006 - DNA, 180 bp, H. influenzae strain 86-028NP
ttgtttaataccatattaacattagcaggatcaccaaattctcactataatgcgcaaaattttgagaatgaaaggataatttgtatgggaatgattattactgttgatggtcctagtggtgctgggaaagggacgctttgttatgcgttggctgaaaagttgggctatgctttttattga

SEQ ID NO: 2007 - DNA, 1005 bp, H. influenzae strain 86-028NP
atgaaaacattaagtgaatttatcgttgaacgccaagcagaatacccaaatgctaaaggggaattgagtggtattttgtcgtcaattcgtcttttagcgaaaataattcatcgagatattaacaaagcaggtttaacaaatattctcggtcaatctggtattgaaaatgtacaaggcgaaagtcaaatgaaactcgatttattcgcccataacacgatgaaagcggcattaatggcacgtgaagaagtggctgggtttgcatctgaagaagaggaaagttttatcgcatttgatacggaacgtggtcgtaatgcaaaatatattattttaacggatccccttgatggctcttcaaatattgatgtaaacgtatccgtcggtacaattttctccatttaccgtcgtgtatcccctattggctcacctgttaccttagaagattttatgcaaccaggtaataaacaagttgcctcgggttatattgtttatggttcatcaacaatgttggtttataccactggtcacggtgtgaatggtttcacttatgatccgtctatcggtacattctgtctttcccacgaaaatatgcaaatgccaaaagagggcaaaatttattccatcaatgaaggacaatacctgaaattcccacaaggtgtgaaaaaatatattaaatattgccaagaagaagataaagcgactcatcgcccttacgtatctcgctatattggttcacttgtagcagacttccaccgcaacttattaaaaggcggcatttatatttatccaagtgcaaccaactatccaaatggaaaactccgtttattatatgaaggcaatcctattgcatttttagcggagcaagctggcggtgtcgcaacagatggttatcgtcgaattttagatatcgaaccaaccgcacttcatgaacgtgttccactttttgttggttcagaagatatggtaaaaaaagcacaagaaatgatggaagaatttaaagaagaataa

SEQ ID NO: 2008 - DNA, 810 bp, H. influenzae strain 86-028NP
atgaaaattgcattaggcattgagtataacgggcaaaattattatggttggcagagacaagaaaaagtccgtagtgtacaagaagaattagaaaaggcactttctcacattgcaaatgaaaaaattgagatattttgtgcaggcagaacggattctggcgtaagtggaacgggtcaggttgttcattttgaaaccaatgcggttcgtccagagaaggcttgggcttttggtacgaatgctcatttacctgatgacattgcggtggcttgggcaaaacaagtcgatgatgaatttcacgccagattttccgcaacagcacgccgttaccgctatattctttattgtaataaattacgctctgcgattttagcgggaggaataacccattgccatttagatttagatgcggaaaaaatgcatcaggcagggcaatgtttacttggcgaacaggatttttcctctttccgtgcggcacaatgtcagtctcatacgccttggcgtaatgtgcatcatttgaatgtgtctcgtatcggaaaatatattattgttgatattcaggcgaacgcttttgtgcatcatatggtgcgcaatattgtgggaagtttgattgaggtcggtgctggaaatcagccgattgaatggatgcaatggctacttgagcagaaaaatcgtcagcttgctgcaccaacagcaaaaccagatggattgtatttggttgatgtgatttatccacaaaagtttgatattcctaaacgcccgattggtcctttatttttagaggatggtttattaaatcgtactttgaagtaa

SEQ ID NO: 2009 - DNA, 1017 bp, H. influenzae strain 86-028NP; identical to SEQ ID NO: 718

SEQ ID NO: 2010 - DNA, 810 bp, H. influenzae strain 86-028NP
atgcccttattacaagtggaagatttaactaaaacttttaaaggtcacgccagtttatttggtcgaaatcaattcaatgcagtggataaagtgagttttacccttgaacgtaaacaaacacttgcaatcattggcaataatggctctggtaaatcaactctagtgaaaatgatagcgggcattattccgccaacttctggtcgaattttatttaatgatcgagaattacaatatcaggatgcccaatctagagctaaacatattcgtatggttttccaagatgccaactctgcatttaatccacgtttaaatattggacaaatattagacgaaccattaagcctagcgacagattggacagaaacacaacgtaatgaaaaaatctttgagaccctctctcttgttggactttatcctgattacacaaatctcaatattaagcatctctctatcagccaaaagcagcgggttgccctagcacgcgcattaattttagcaccagaaattattataatagatgatgcaattggcaatttagatgcttctgtacgtattcaattgcttaatttaacccttgatttacaacaacgtttaggtatatcttatatttatgtgggacaggatctcggtgtaattaaacatattgcagatacgattatcgtaatggatgacggaaaaatgattgaatatggcagccctcaaaatctttttactgatccacaaactgatgttactcgtcgcttagtcgaaagctattttggcaaaattttagatgaaaccgcttgggtaaaagacaaaaacactcactaa

SEQ ID NO: 2011 - DNA, 1050 bp, H. influenzae strain 86-028NP
atggcacttttagacatttgtaacctcaatattgaaattcaaacctccaatggacgtataaaaattgtagatggcgtcaatctttcccttaacgaaggggaaatcagtggattagttggcgaatcaggctcaggaaaaagcttaatcgctaaagtcatttgtaatgcaatcaaagaaaattggattattactgccgatcgctttcgttttcacgatatcgaattactaaaactcagtcctaataaacgacgtaagattgtcggcaaagaaatatccatgattttccaaaatcccttatcttgccttgatccaagtcgaaaaatagggaaacaactcatccaaaatattcctaattggacatttaaaaataaatggtggaaatggtttgggtggaaaaaaagacgtgctattgaattgttacatcgcgtaggaattaaagatcatcgtgatattatggcaagctatcctaacgaactgacagaaggcgaaggacaaaaagttatgatcgcaatggctgtcgctaatcagccacgtttattaatcgcagatgaaccaacaaatacattagaatcaaccactgccctacaagtttttcgtttactttccagtatgaaccaaaatcagggaacaacaattttacttacgagtaacgatattaaaagtattagtgaatggtgcgatcaaatttcagtgctttattgtgggcaaaataccgaatctgccccgactgaaatattaatcgaaagtccccatcatccttatacccaagccttaattaatgcagtacccgattttactcaacctttggggtttaaaactaaattgggtacgttagaaggcaccgcgcctattttagagcaaatgccaattggctgtcgtcttggcccaagatgcccttttgcacaaaaaaaatgtatggaaaaaccaagacgattgaaaataaaacaacacgaattttcttgtcattatcctattaatttacgagaaaaaaatttcaaagaaaaaacaaccgccaccccttttatacttaattgcaaaggaaatgaataa

SEQ ID NO: 2012 - DNA, 888 bp, H. influenzae strain 86-028NP; identical to SEQ ID NO: 748

SEQ ID NO: 2013 - DNA, 966 bp, H. influenzae strain 86-028NP
atgttctggtcggttcttcgccatattctgtgggtggcattattattactcgtattatcgctattaggctttgttattttattgcgcgatcctcttaatgcgaatcttgttacacaaaacatttatatcggctatttccattatttaggcaccttgttacaaggtgattttggcattacctataacggtggaaaatcattaatgaaccttattcttacggttcttcctcccacattggaactttgtttcattacattgtttttggcatttatttttggtttgccacttggcattataagtgcggtcaattctgaacaagtttttgcaaaaagtttacaaatcctatcttatgtagggctatctattccaatattttggttagcccccattttactgtatgttgccgcgctctcacattgggaaattgccgctattggacaatataatttgctttacgaaattaaacccattacgggatttcctgttattgatatgtggtttatggaagtaccttatcgtacaaaaatcgtacaaaacatattgcaacatttagccttaccaacattggtattgtgtattttgccaacaatggaaattatccgtattattcatcaacgagcagaatatattttgaatcaaaatttttctaaagtagcgacaacacggggttggtcaaaatggaaaattctccatcaatatgtattccgtaatacttttcccctgcttgttccacaagtaccacgtgtattcacattagtattaacgcaatgtatgttggtagaaacggctttaggttggcctggcattggtcgttggttaattaatgccgtaaatgaacaagattacaacagcattgccgcaggtgtaattgttattggtgtatgtattattttgattgatacattcactaaaatattcacttttatactcgatccatttaaaaagaaaggttggtatgcaagataa

SEQ ID NO: 2014 - DNA, 1695 bp, H. influenzae strain 86-028NP; identical to SEQ ID NO: 617

SEQ ID NO: 2015 - DNA, 1413 bp, H. influenzae strain 86-028NP
atgtttaatcgggttcaaaaggaaatcaatcaaattattaatcgtggttttgatcgcactttgcgtttagcggtaacagggttaagtcggagtggaaaaacggcgtttattacaagtttaatcaatcaacttctctccattaatcaacattcatcacagaatttgcccttgtttgaagcagcgagaaatggtgcgatcttggcagtcaaacgagtatcccaacaagatctcagcgtgccacgttttgattatgaaagtaatttaaatgatttgtcacaaaatccgcctcaatggtttcaatctactcgtggcgtgagtgaaacgcgtttagccattcgttttcaacgccaatctggcttgctacgccatttgaaagaacgaggcacgctttatctagatatttttgattatccaggggaatggctgatcgatttgccgttattaaatctagattttcaacaatggtcacaagagcaaattaaggtaacaacaggcattcgtgaagaattggcggagaattggctcgctatgttgcaggatttggatttaagtgcggtcgcaaatgaagatgttttagccaagatagcgaaaagttatacggattatttacatcaatgcaaagtgcaaggcatgcaatttattcagcctgggcgatttgtattgccgagtgatttagagggcacgcccgcattacaatttttcccattaattcatctttcagaagaacagtggcgaaccttgaaaaaaacagcaaaatcaaatagctattttgctgtgctgacaaaacgttatgattattatcgcaataaaattgtgaaaggtttttacgaaaattatttttctacctttgatcgtcaagttattttggcggattgtttaacgcctttaaatcacagtcagcaagcctttttagatatgcaaatgggcttaaatcagttatttaataatttccattatggcagcagaaattttcttcatcgtttgttttctccgcgaattgatcgattaatgtttgttgcgacaaaggcggatcatattactcgtgatcaaattcctaatttagtaagtttaatgcgccaaattgtgcaagagggtggtcgccatgtggaatttgaaggaatcgatacggaatataccgccattgcggctgttcgtaccacaaagcaagtgattgtgaatcagcaaggaaaagaaattaaagcaattcaaggggttcgttctattgataaacagctgattacactttatccgggaacggtgccgagcaaattaccaagagcagaattttggcaaaaacaaccgcactttgattttgatagttttgaacctcagcctttagaacaaggggagagcattcctcatttgagaatggatgcggttttacaatttttattaagtgatcgatttgaataa

SEQ ID NO: 2016 - DNA, 2640 bp, H. influenzae strain 86-028NP
atgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgctttcagtcaatttttaaacctcactaacatagcagaacaatatcaaaccatttcccgtgaacattctcttgcacaaagttcttctcaatccttaagcgaacttttcaaacgcttaaaagaacaaaatgcttcagtggaagaggtgcataaaaccgtcgaaaaattattaattgagcttgttctgaccgcacatccaacagaaacaacacgtcgttcattaattcataaacacattgaaatcaataaatgtttaagcaagctagaacatcatgatttaacggaaaaagaacgcaatattattgaacgtctattacttcgtttaatcgctgaagcatggcataccaacgaaattcgtactgttcgcccaacgccatttgatgaggctaaatggggctttgcgatgttagaaaacagtttgtggcaagctgtgccagaatttttacgccaactcaacgaaaccgcccgtgaatttttaggttacgatttgccggtaggattaaaacctgtgcgtatttcctcttggatgggcggcgaccgtgatggaaatccatttgttaccgcacaaattaccaaaaaagtactttattttgcccgctggaaagcggcggatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggagccgctttacgattgttatcaatctttaattcaatgtggtatgcgcattattgcaaatggttcattgttggatattttgcaccgtattagttgttttggtgtgacgctttctcaaatggatattcgccaagaaagcactcgtcacaccgatgccattgctgaaatcatgcgctatattggtttgggcgattactctcaatggatggaagacgataaacaggctttcttaattcgtgaattaagctctcgccgtccattgattccgcaaaactggacgccatcgcctgaaaccaaagaaattttagatacttgtaaagtcattgctcaacaaaaacaaggtgtcattgcgtgttatgttatttcgatggcgcgcagtgcatctgatgttttagccgttcatttactcttaaaagaagctggcgtgccatatcatattcctgttgtgccattattcgaaaccttagaggatttagatgcagccgaaaaagtgatgactcaacttttcaatgtgggttggtatcgtggcgtgatcaataatcgtcaaatggtaatgattggctattcagattcggcaaaagatgcgggaatgatggctgcttcttgggcgcaataccgtgcgcaagaagccttagtaaatttaacagaaaaacttggcattgaactcactttattccacggacgtggtggcacaattggtcgtggcggtgcgccagcacatgcggcattactttctcagccacctcgttcattaaaaaatggtttacgtgtaacagaacaaggcgaaatgattcgtttcaaactgggtttacccgcagtagcagtagaaacctttgatctctacgccagcgccattttagaagcaaatcttttaccaccaccagaaccgaaaccagaatggcgtactataatggacgagctttccacgatttcttgcgatatttatcgtggtgtggtgcgtggcgataaagattttgtgccttatttccgcagtgcgacgccagaacaggaactctccaaattgccgcttggctctcgccctgcaaaacgcaatccaaatggcggtgtggaaagtttacgtgcgatcccgtggatttttgcctggatgcaaaaccgtttaatgctgccagcttggttaggggctggtgcagctattcgtcaagttattgaacaaggcaaaggcgatattattcataaaatgtgcgaaaactggccgttcttttcaacgcgaatcggaatgttggaaatggtatttagtaaatcggatacttggctttcccaacaatatgatcaacgattagtgaaaaaagagctttggtatttaggtgaaaatttacgtaagcaacttgaagatgatattcaaactgtgctttcactttctcaccaaagtgaattgatgtctgatttaccttggattgcagattcaattgcattacgtaatatctacacggatccactcaatctactgcaagtggaattgcttcaccgtttccgtgaaaatccagagcaagtcaatcccgatgtggaacaagcattgatgattaccatcacaggtatcgcggctgggatgcgcaatacaggctag

SEQ ID NO: 2017 - DNA, 1011 bp, H. influenzae strain 86-028NP
atggcaacaattaaagatgtggcaaaaatggctggtgtgtccaccacaaccgtatctcacgtaattaataaaacccgtttcgttgcaaaagatacggaagaagcggtgttatccgcaattaaacaacttaattattcccctagtgctgtggcacgcagtttaaaagtcaataccaccaaatccattggtatgattgtgacaaccagtgaagcaccgtattttgccgaaataatccattctgttgaagaacattgctatcgacaaggttattctttatttttgtgtaacacacaaaatgatcctgaaaaagtcaaaaatcatttagaaatgttggcaaaaaaaagggtcgatggtttgcttgtaatgtgttctgaatatactcaggattcattggatttactttcatcattttccactattccaatggttgtaatggattggggcccaaatgcgaataccgatgtgattgatgatcatagttttgatggcggttatttagcaaccaaacatcttatagagtgcggtcataaaaaaatcgggattatctgcggcgaactcaataaaactaccgcaagaacgcgttatgaaggctttgaaaaagcaatggaagaagctaaattaacaatcaatccgtcttgggtactagagggtgcatttgagcctgaagatggctatgaatgtatgaatcgtttactgactcaagaggaattaccaaccgccctattctgctgtaacgatgtgatggcactcggtgcaatatcagcactaacagaaaaaggcttgcgtgtgccagaggatatgtcaattatcggctatgatgatattcacgcctcacgtttctacgcaccaccattaaccaccattcatcaatcaaaactacgtttaggcagacaggcagtaaatattctattagaacgaattactcacaaagatgaaggtgttcaacaatatagtcgtatcgatataacccctgagcttatcattcgaaaatccgttaaatcgattttataa

SEQ ID NO: 2018 - DNA, 894 bp, H. influenzae strain 86-028NP
ttgcttgcccgtttaaaatatggtaaaactaatgccgttttattcacaacatatataggaagttctatgtcaaatttacaagcaattattgaagctgcatttgaaaaacgtgcagaaattacaccaaaaaccgttgatgcagaaacgcatgcggcaattgaagaagtgatcgaaggattagattctggaaaatatcgtgtagccgaaaaaattgctggcgaatgggtaacacatcaatggttaaaaaaagcggtattgctatctttccgcattaacgataaccaaatcattgacggcgcagaaacaaaatattacgacaaagtggcattaaaatttgcggattacactgaagaacgttttactgaagaaggtttccgtgttgtgccttctgcaacggtgcgtaaaggcgcatatatttctaaaaactgcgtattaatgccatcttatgtaaacattggtgcttacgttggcgaaggcaccatggtagatacttgggcgacggtaggttcatgcgcacaaattggtaaaaacgtgcatttatcgggtggtgtaggcatcggcggcgtgttagaaccattacaagctaacccaaccattatcggcgataactgttttattggcgcgcgttcagaagtggttgagggtgttatcgttgaagatggttgtgttatttcaatgggcgtattcattggtcaatcaaccaaaatttatgatcgtgaaacaggcgaaattcattacggccgtgtaccagcaggttctgtggtggtatcaggtagccttccatcaaaatgtggaaaatatagcctatattgtgccgtgatcgtgaaaaaagtggatgcaaaaactttaggaaaagtgggcatcaatgaattattacgttctattgaagaatag

SEQ ID NO: 2019 - DNA, 1299 bp, H. influenzae strain 86-028NP
atgggaaaaagcgttgttatcttaggcgcacaatggggcgatgaaggtaaaggaaaaatcgttgatcttttgacggatcgcgtaaaatacgtagttcgttatcaaggcggccataacgcaggtcacacacttattatcaatggcgaaaaaaccgtattacgtttaattccatctggtatgttacatccaaacgtaacttgcttaattggtaatggcgttgtggtttcgcctgaagcattaatgaaagaaatgggcgaacttgaaagccgaggtattaaagttcgtgaacgtttattaatttcagaagcttgtcctttgattctgccttatcacgttgcaatggatcacgcacgcgaagcagcccttggcaaaaaagctataggtacaactggtcgtggtattggcccagcttatgaagataaagtagctcgtcgtggtttacgcgtaggcgatttatttaataaagaagcctttgccgaaaaactcaaaaacatccttgaatactataatttccaattggtgaactactacaaagttgaacctgtcgattatcaaaaaaccttagatgatgtaatggcaattgccgatgtaatcacaggtatggtggcagatatcactacaattcttgatactgcgcgcaaaaatggcgaacatattttatttgaaggcgcacaagggacaatgttagatatcgaccacggtacttatccgtatgtaaccagctcaaacacaacggctggtggtgttgcaacaggctctggttttggcccgcgtaatcttgattatgtacttggtatcattaaggcttactgtactcgtgtaggtggtggcccattcacaactgaattatttgatgatgtaggtgctgaaattgcacgtaaaggtaacgaatttggtgcggtaacaggccgtccacgtcgttgcggttggttcgatgccgtcgccattcgtcgtgcaatccaacttaactctatttctggtttctgtatgactaaactagacgtattagatggttttgatgaagtaaaaatctgtgttgcttacaaaatgccaaatggcgaaatcgttgaatatgcaccgttagcggcgaaagattgggaaggtgtagaaccaatttatgaaacattaccaggttggaaagaaaatactttccgcatcacagatgtaaataaattgccacaaaactgcattaactatattaaacgtattgaagaagtaactggcgtacctattgatattctttcaactggccctgatcgtgtagaaacaatgattttacgtgatccgttcgctgcttaa

SEQ ID NO: 2020 - DNA, 366 bp, H. influenzae strain 86-028NP
atgccccatctctcagtcgccaaatttggcggaacatctgttgctaactacaatgcgatgacagcttgtgcaaaaattgtcattgccgatcccaatacacgcgtagttgtgctttctgcatcagctggtgtaacaaatttattagtggctttagtaaatggtgtaaaagcgacagaacgtgaaaaattaattggcaatgatctgcatatcacttcaggtgtggcaaaacgtatttttgatactgttcaatcttataatgtgcgaatgattagttatggggcaagtaccaacaatgtttgtatgttagtacaaagtgaacattctgatgaaattgtacgctcgttacacaaatccttatttgaataa

SEQ ID NO: 2021 - DNA, 288 bp, H. influenzae strain 86-028NP
atggcatttaaatttaacgctgaagttcgtacagcgcaaggtaagggtgcgagccgccgcctgcgtaacaatggtcaaatccctgcaatcgtttatggtggcagcgaagagcccgtttcaatcatcttaaaccacgatgaattaaacaacgcgcaagcacacgaatctttctattctgaagtgattactttagtgatcggtggtaaagaagttgcagttaaagtacaagcaatgcaacgtcacccattcaaaccaaaattggttcacattgacttcaaacgcgcgtaa

SEQ ID NO: 2022 - DNA, 657 bp, H. influenzae strain 86-028NP
gtgaaccaattttttatcacatctattaatataataaaaaagcaggaacaaatggaatttttaattggattttttactgaatatggttattgggctgttctttttgttttaattatttgtggatttggtgtgccgattccagaagatatcacgttagtttctggcggtgtcattgcggggctttatccagaaaatgtcaattctcatttgatgttgctggttagtatgattggtgtgcttgctggcgattcctgtatgtattggcttggtcgaatttatggcacgaaaattttacgtttccgaccaatacgtagaatcgtaacattacagcgtttaagaattgtgcgtgaaaaattcagtcaatatggcaatcgagtactgtttgttgcacgatttttacccggtttacgtgctccaatttatatggtatcaggtattacacgccgtgtaagttatgttcgttttgttttaatagatttctgtgctgcgattatttctgtacctatttggatttatcttggggaattgggggctaaaaatttagattggctacatacacaaattcaaaaaggtcaaattgtgatttatatatttgttgggttacttgtactattctttttttggaaatggaaaaaatctaaaaaatcaacgcaataa

SEQ ID NO: 2023 - DNA, 417 bp, H. influenzae strain 86-028NP
atggaaaattggacaaatgaaatttgggtagcaattggtatcgcttttattgttgggttatttattggttacattattgtgcgtttaaccaaaggctcggtaaaacatcaagctaaaacagaggctgaattaaaaacagtcaaaacccagcttgatacacaaaaggcgcaaatcgaaaaacattttgcagaaagtgctgagttattcaaaaccttaattaacgattatcaaaaactttatcgccactacgcaacttcctccaataatttactgggcgaaaaagatcacaaaggtttattcacccaacagttaattactgcaacagataaatctcaaaatgaacagcctagagattattcggatggtgcatcaggcttatttaaagaaaataaagaagaaaataaagaagaaaattaa

SEQ ID NO: 2024 - DNA, 351 bp, H. influenzae strain 86-028NP
atgacaattcaacgcattttacccaatgcacgtttaagtgaagtttcaattcataacaacctcgcctattttgcagggcaagttccagaattaaccatcgagcaaaatacctacgaacaaaccaaagaagtattaggtttaattgataaattgttagcagaaattggctccaataaaagcaatattttaactgcgcaaattttcttggcagatatgcaagattatgttcaattaaatcaagcttgggatgaatgggtcgatcatgttagcccaccaagtcgagcgacagtggaagctaaattagcggatcctcgttggaaagttgaaattgttattattgcaacttgttag

SEQ ID NO: 2025 - DNA, 717 bp, H. influenzae strain 86-028NP
atgaaactgcttatctctaatcagcacggtgctattgttatggcactactgccttttatttatggtatgttgcttgctaatccagtatgggcgcacatgtttttattattaggatggttttcgctttatttgatgacttatccttttttgaatttgtttaaaggtaaaaatcttgagttatataaaaaatggtctgtgatttattttgctgccgccgtgatttttgcgattcccgcgttaatttataattggcaggtgttgtattttatgtttgccatgttaccgtttgttgcggtgaatatttatttcaccaagaaaaaagatgagcgcaatttatggaatgacttggcagggatcttaatttttgccctagctggaatgggatcctattacttttctgaccgcacttttgatgaaaaaatactttgggtggcgatttatccaacattattttttattggaacaacactttatgtaaaatcaatgatgcgtgaacgaaaaaatccacgttatttttgggcatcagtgatttttcacttattatgtgtgctgatttttgtggtttcgcaacaatttattttagcattagcttttgtgcctggattagtgcgagcggtttatctgcccactaaaaagctttctgttatgcaagttggactaacagaatttgcgattactgccgtattttttattttacttttagtagcaaccttgtaa

SEQ ID NO: 2026 - DNA, 543 bp, H. influenzae strain 86-028NP
atgaaactgaagttattttttcatatagtattactttgttttagtttgcctgtttgggcgatgaaaaccattgatattacagcgaattcgaaaatggatgatcaagcaagaatgaatttggcgcaagagtttgccaataaacagcaatggagctctgttttcgatatcatgtatccgatggcgttagagggaaacaccactgctcaaagcaatctaggtatgttatataaccttgggcgtggcacggtgagagactatgaaaaggcttattggtggtttagcgaagcggcagagaagggtagtgtgaaagggctaaataaccttggcgttatgtatctacgtggcgattacgtcaaacaaaatacagagcaagccattaagctttttgaacgtacagctcgagctaaagatacggatgcgatgatgatgttaagtaatatttatcgcttacaaaaccaacctgaaaaatcattggaatggctgaaaaaagcagctgaattaggcaataaggaagcaaaacagcgtttatctagtcagccataa

SEQ ID NO: 2027 - DNA, 459 bp, H. influenzae strain 86-028NP
atgataaaatatgaagtaactttagaatcaagtcattttttaaggaaattgatgaaaattggagcacttgctaaagccctaggctgtaccgtagaaaccatccgttattatgaacaacaaggtttaatcccgcccccaaaacgtactttaggcaattttcggcaatataatgaagaacacttgcaacgtttatcatttatttgtaactgccgaaatttagatatttcattaagtgaaataaaaagcctactgaatttagaaaatgcctccaaacaacaagcagaagaaattaatcgtgtgttagataaacacattaaagaggtggcaacaaggattcacgaactcgcccatttacggatgaaattaattgaattacgtgaaaaaacagtctcgaatgatgaagatccaatgaaattgctattgcaacatagtggcgtgaaatttgtgcgattaaaatag

SEQ ID NO: 2028 - DNA, 684 bp, H. influenzae strain 86-028NP
atggaattgaaaaaaatcgctgtaggattaaccgcacttttaggtatgtctgttgctaacgcacataatgtttggcttgagcctgcttcatcgcaagatgaatacgtagtgaaatttggacatgaacaaactgaaacctatccagaatctaaacttaaatctatccaagccttaaatgcgcaaggcaaattaactgctgttgattaccaattcagaaatggcgaagcctatcttatgcctaaatcagatttagttttcgttcatttcgataatggtgtatggtcaaaattaccaagcggtaaatacgttgaaaaaacaaaacgtgaagaaccaacagcagaatttagtactaatcctgttaaatttggtaaagcgattttgaaatgggatgctgaatctttcaaatctcatcaacaagcatacgaattgattcctcaagaaaaagcacaagcgaataaaccactttctatccttgttttacataatggtaaaccagttcaaggcattaaagtgggtgtgagtgaagatgcaccgttcaatttaactaatgaaaaaggtatcgctcaatttaccccaactaaaggcttcaacaaagtatgggcagagtttgaggaaaaagtaacaaataatgcagattacgatcgtcgaactgtggaatatatgctaacttttgatgcgcaataa

SEQ ID NO: 2029 - DNA, 489 bp, H. influenzae strain 86-028NP
atgaaaaaatttgcttttttaaccgcactttttgcggcttgctatctcccgaatgcttatgcccacgcgctttatgtgtttgcccaatatgatgggcaaacactttctggcaaatcctattattctgatatgaccccagcagctgaaacttatttagaagttttccgctcaggtgtttctgatcccgttttaactggaaaaacagaccgccaaggtgcatttaagctttctattgctgatgtaccacatacaaccttaaaagttgtggtggaaggcgatgaaggacaccgtgcgtccgttgttgctgctgctcatacgtctgccgaaaatcaaagcagtgcagatttaatgctgcttcgtgaagatattgcgcatttaaaagataaaatttatttgcatgatattttaggtggaatcggttatatcgttggtattgctggacttattgctttacgtaatgcgcgtaaaattaaacaaggacgtatttaa

SEQ ID NO: 2030 - DNA, 621 bp, H. influenzae strain 86-028NP
atgcatttatctgaaggcgtgttacatacgcctattttattagctggtgcagtgcttgctgttgcgggcattgctgtgggggtacgtcgtttagaatcagaacgtttaccgctcaccgcactttttgccgctgcattttttgtggcaggaaccattcatgtgcctgtaggaattggtagcgtgcatttaattttaaatggcatggctggtttatttcttgggtgggccgtttttccagcattcctcatcgcacttttattgcaagtcattttcttttcttttggtggatttgccgtgttaggtgtcaatctttgcgtgatggcaataccagctgtgatcgcttattatcttttccgttctcgtttacagccacaaatggcattaaaagatcgcttattagtcggtattggtgctggcgtaattggcgttggcggagcaggcgtgcttgcttcttttgtgctgatgttagatggtggtaaaagttatctgaatcttgtttggctcttgctagtctctcatattccagtatttgttttggatagtattatcagcgtaggggtgattaccttgcttggtaaaatgtatcctgaagtcatgaatcgtaccgagaatttctcttaa

SEQ ID NO: 2031 - DNA, 633 bp, H. influenzae strain 86-028NP
atgaaaattcatcgcttatttcaaccgcactttaggttgatttatctgtttatctgggggctaatcattagtggattgagtgatcttacttggcttatctcccttaatgtgcttgcagtttctctcttttttatttcactgcagctcagtcaaaaatcttttttgccttatcttaaacgttggtttgctttagtcatttttattgctttaatgtgggcggcattaagttggcaaattggagaaaatggcattgaactcaattttcaaggcattgaattagcagaaaaattgagtttgcggactcatttattgttgatttctctttggctttttttgtggaatattaatgatgcagtacttgttcaagccattggtaaattgcctttgccagaaaaattaattcaactttttgtgctgaccgtacgttacattgcactgcttggcgaactgcgtcaaaaaatggatattgccatgcgagctcgtggatttcgtcctgggcttaatcgccgaaccctttatgtgacggctcaaagtgtcgctttattattgatccatgccctattaaaagccgaaacggcgcaaatggcgttaaaatgtcgtggttttcagtttggcaaaaagagagaaaaataa

SEQ ID NO: 2032 - DNA, 627 bp, H. influenzae strain 86-028NP
atgttagctgtaaataatctttgtatagaacgcaatggtagagcgattattcaagatttgagttttaccttggaaggtcaaaaacgcctcttcgtacaaggggaaattggttcaggaaaaaccactttactgcttgctttgttgggatttgttcctgtaaccaaaggggaaattaaattatttggcaaagtttgtcgtgaagaaaaagattttgcgccctttcgtggcacgattggtatttgttttcaaaatgccgatgatcaactttttggcccaacagtgttggatgatgttgccttcgggccattaaaccaaaatatgcccagagagcaggcgtatcatatcgcagagcagcaattagaacgtcttggtatcacaggtttaaaagatcgtatggtgcataccctatctggtggtgagaaaaatttcacggcacttgctggtgtcttagcgatgcagccaaaaattttattattagatgaacccaccaatggattagatcgaaaaaatactgaaaaattgaccgcacttttgcgtgagctttccttacccatgttgatttcatcccatcatcatggatttattaacgaattagccacagaaattattagatttaccaacaaatga

SEQ ID NO: 2033 - DNA, 1191 bp, H. influenzae strain 86-028NP
atgtttgaacatattaaagcggcaccagccgatccaatcttaggcttaggcgaagcattcaaatccgaaactcgcgaaaataaaattaacttgggtattggcgtttataaagatgcgcaaggcacaaccccgattatgcgtgcagtgaaagaagcagaaaaacgcttatttgataaggaaaaaacgaaaaattatctgactatcgatggtattgctgattataacgaacaaacaaaagcgttacttttcggtaaagattctgaagtcatcaaatctaatcgtgcaagaacagtacaaagtttaggcggaacaggcgcattacgcattgcggcagaatttattaaacgtcaaactaaagcacaaaatgtttggatcagcaccccaacttggccaaaccacaatgccattttcaatgccgtcggtatgacaattcgtgaatatcgttattatgatgctgaacgcaaagcccttgattgggatcatttacttgaagatttaagccaagcaagcgaaggcgatgtggtgcttttacacggttgttgccataatccgactggtattgaccctactccagaacaatggcaagaattagccgcactttcggcgaaaaacggctggttgccactctttgactttgcttatcaaggtttagccaatggattagatgaagatgcttatggcttgcgtgcttttgcggcaaaccacaaagaattgttagtagcgagttcattctcgaaaaactttggtttatataatgaacgtgttggtgcctttactcttgtggcagaaaatgcagaaattgcatcaaccgcattaacccaagtgaaatcaattattcgtacactctactctaaccctgcatctcacggcggcgcaactgtagcaacagtattaaatgacactcaacttcgccaagagtgggaaaatgaattaactgaaatgcgcgaacgtatcaaaaaaatgcgtcatttattcgttcagttattaaaagaatacggtgcggaacaagatttcagctttatcattgaacaaaacggtatgttctctttcagtggattaactggggaacaagtggatcgcttaaaagaagaatttgccatttatgctgttcgttctggtcgtatcaatgtggctggtattactgaagataatattcgctatttatgtgaaagcattgtgaaagtgctttaa

SEQ ID NO: 2034 - DNA, 1089 bp, H. influenzae strain 86-028NP
atgcaaaactccaccttatacccaacggtttatgtacttggcaacggacaactcggcagaatgttaggttacgctggtgcacctttagatatttatgttgaacccttagccttcaatgcgccagtttttgacttacctgaaaatgcgatcatcacggcagaaattgaacgctgggaaaaaacacctttgactgaattactcggcaatcataaaaacttcgttaatcaacatgtatttggattattagccgatcgttttgctcaaaaatccttgcttgatgaactcaatctttctacctcgccttggtgtttattaaaagataaaacgcaatggaatgatgttttccaaactgttggcgagaaagtcgtcgtcaaacgtagaacaggcggatatgatgggcgtggtcaatggattatcagcgatgaaaacaaagcggacatcactgatgacttatttggtgaagtgatcgcagaaaaatttattccttttgattatgaagtttctattgtaggcgcaagatttaaaaatggcgaaaagcgtttttatcccgttacgcataacctgcaacaaaatggtattttgcgttacagtgtgattgataatgcatttcctcaacaatccgcacaacaaaaacaagctgaaacaatgctcggcaaaattatggataagttaggctatgtgggtgtgatggcaatggaatgttttgttgtaggcgacaaattactaattaacgaacttgcgcctcgcgtacataacagtggacattggacacaactgggatgtgctattagtcaatttgaattacatttacgcacgctacttgatttgccaacacctgacttacaaatttttgccccaagtgtaatggtaaatttaatcggcacaaaccataatccaaaatggcttaatataccttttgcacaacttcattggtacggtaaagaagtgagggctgggcgtaaggttgggcatatcaatctttctcatcctaataaagcggtcattattcaacaattagaaaagctccgaattgaattacccgaagattatcaatcaggattaaattgggcgattgaaaaactaaaataa

SEQ ID NO: 2035 - DNA, 495 bp, H. influenzae strain 86-028NP; identical to SEQ ID NO: 621

SEQ ID NO: 2036 - DNA, 249 bp, H. influenzae strain 86-028NP
atgggacgaactgaaaaattattagataagctcgcacaatcaaaatctacatttaattggaatgaattagtttctttgttagctcaacaaggttatgaaaagcgagaaatggcaggctctcgagtgagattttataatagaacactcgaacatacgattttgttacacaagcctcaccctgaaaattatattaaaggtggtgctttaaagtcagtgaaagaatcattaaaacaggtaggtattctatga

SEQ ID NO: 2037 - DNA, 345 bp, H. influenzae strain 86-028NP
atgaagttattaaattataaaggttatgttggcacgattgaggcggatttagaaaacaatatattgtttggcaaacttgcttacattcgtgatttagtgacttacgaagcagagtcattatctgagctagaaaaagaatttcgtcaatctgttgatttatatttacaagattgtttggaattaggtaaagaaccgaataagccttttaaaggtgtatttaatgtacgaattggcgaggaattgcatagagaagctacgatcatagcaggcgatcgttctcttaatgcttttgttacggaagcgattcaagaaaaaatttttcgtgaaaaaccaagtttaagataa

SEQ ID NO: 2038 - DNA, 2610 bp, H. influenzae strain 86-028NP
atgttagccaaagcaaaatatagaaaagattacaaacaaccagattttacggtcacagacatttatttagattttcaacttgatcctaaacatactgtggtaaccgcaagcacaaaattccaacgcttaaatgatgaagcgacttctttacgtttagacgggcatagcttccagttttcttctattaaatttaatggcgagccattttctgcttatcaacaagatggcgagagtttaacgctcgatttgaaaggcaaaagtgcggaagaatttgaacttgaaattgtgactttccttgtgccagctgaaaatacttcattacaaggattgtatcagtctggcgagggtatttgtacgcaatgtgaggcggaaggtttccgtcaaatcacttatatgcttgaccgtccagatgtattggcgtgctatacaaccaaaattacggcggacaaaagcaaatatccattcttactttctaatggcaatcgcattgcaagtggcgaattagaagatggtcgtcattgggtggaatggaatgacccattcccaaaaccaagctatttatttgctttagtggcaggggattttgatttattacaagataaatttattactaaaagtggccgtgaagttgcgttagagctttatgtggatcgcggtaatcttaaccgtgcaacttgggcaatggaaagtttgaaaaaagcgatgaaatgggatgaagatcgctttaatttagaatacgacttagatatttatatgatcgtcgctgtcgattttttcaatatgggtgcaatggaaaacaaagggttgaatatttttaattctaaatttgtattagccaatccacaaacggcaacagatgaggattatcttgctattgaaagtgtgattgcacacgaatatttccataactggacaggcaatcgtgtgacttgccgtgattggttccaattaagtttgaaagaaggcttaacggttttccgtgatcaagaattttcttcagatacaggttcgcgtgcagtgaatcgcattaataatgtgaaatttttacgcactgtgcaatttgccgaagatgcaagcccaatgtcacacccaattcgccctgaaaaagtgattgaaatgaataatttttataccgtaaccgtatatgaaaaaggggcagaagtgattcgtatgttgcataccttattaggtgaacaaggcttccaaaaagggatgcagctttatattgctgaaaatgatggcaaagcggcaacctgtgaagattttgtttctgcgatggaacgtgcaaataacctcgatttaaaccagttccgccgttggtatagccaatcgggtacaccagaattattgattagcgatgcttatgacgaaaaaacgcatacttatcgtttaacggtttcacaatccacaccgccaaccgcagatcaaatggaaaaagtgaatttacatattccattaaaaatcgcgctttatgatgcgaatggcacgaaacaaatgttacaacataatggcgaattgttgagtgatgtattaaatgtcactgaaaaagaccaagtctttgaatttcacggcatttatggtcgcccaattccagcattattatgtgatttttctgcgccagtaaaactggattatgattataaaacggaacagttattaggcttgctgaaatttgcagacaatcaatttatccgttgggatgcagcacaaatgctatttgcgcaagaattacgtcgtaatgttgtgcgtttccaacaaggcgaggcactagaaatttcgcctgaaattttgaccgcactttcttatgttctgaataattacgagaaagatattgaactggcaacattaattctcacactgccgaaagaaatggaatttgcggaaggtttcaaaactatcgatcctgatggtatttcagtcgcaagagcatttatgcaagcgcaaattgcagaatcgttaaaagatgatttcttgcgtgtttatacccatattcgtcttgatgattatcaagttacgcaacaagacatcgccttgcgtgcaatgcgtaatctttgcttaacttatttggcttatacgaatttgggtaacaacttagtgcaaaaacactataataatgcgaataatatgacagatacattggcagcattaagtgttgcaactaaagctgcattaccttgcagagatgcgttattagctgattttgaacaaaaatggcaacaggatggattagtgatggataaatggtttgcattacaagccactcgcccagatgaaaatgtgttggaaattattcagttattaatggatcacccaagttttaattttaataatccaaaccgtttacgttcattagtgggtagttttgcaaatcacaatttaaaagcatttcacaacgtaagcggttctggctatcgtttcttaacggatgtgttaatccgtttaaatgaaagtaatccacaagtggctgcgcgtttaatcgagccattaattcgattttctcgctttgatgctcaacgccaaacgctgatgaaacgtgctttagaacgcctaagcgttgtagaaaatctttcaaaagatttatttgaaaaaattgagaaagcgttgcagtaa

SEQ ID NO: 2039 - DNA, 615 bp, H. influenzae strain 86-028NP
atgtttactggaattgtacaaggcaccgcccccatccactccattaaagaaacggctaattttagaacacaagtggtaaaattactacctgaaatgcgtaaagatctggaaattggcgcatcaatagcaaataacggtgtatgtttaactgtaactgaaatcaatggcgatctggttagctttgatctgatgcaagaaactttaaaaattacaaatctcggcacaataaaagtgggcgattatgtgaatatcgaacgtgctatgcaaatgggaacggaaattggcggacatttattatctggtcatatttattgcaccgcaaaaatttcagatattatcgctagtgaaaataaccgacaaatttggttcgagctcccaaacgcagatgtaatgaaatacattttaacgaaaggatttgttgcggtagatggtattagcctcactattggtgaagtaaaaggcacgcaattctgtgtgaatttaatccctgaaaccttgcaaagaacgttaatggggcaacgtaaagtgggcgatattgtgaatattgaaatcgatcctcaaacgcaagctattgtagatactgtagaaaattatttgcagtcaaaaaatttttag

SEQ ID NO: 2040 - DNA, 1395 bp, H. influenzae strain 86-028NP
atgaattttcgtcttttatctcaataccacgctgatattaaaaagttgattaaaatttccttgcctattttattagcacaaatcgcacaaaactcaatgggattagcggataccattatggcgggtcgtgtgagttccactgatatggcagccatttctattggtgcttcaatttggatgccattgatgctttttggacaaggtttattgttggcattgccgcctacaatttcttatttgaatggttcaggccaacgccatcgcattgcccatcaagttcgccaaggcatttggcttgtgttaggcgtgagtattcctttagggttgctgatttatttctgtgaaattccgctgcaatatatgcaaatggaaagcaaaatgtcagatttagcacgggattatttacatgcgatgttgtggggattgccagcctatttgatgctgattaattttcgctgtttaaatgatggtattgctaaaactaagcctgcgatggtcattacctttttaggtttgctaattaatattccacttaattacatttttatttatggaaaatttggcatacctgcttttggtgcggtgggctgtggtattgcaacagctattgtgaactgggcaatgtgcttaatgatgattttttattcctatacgaatgctcaagaacgttcactaaaagtatttagccaattaatcgaaatgccaaatctgaaaacacttaaaaaattactgcgtttaggattacccattgccattgcaatttgttgtgaagtggcgttatttgcacttacgtctttaatgctttctccgctgggtgcaactattgtcgcaagccatcaaatcacattgaataccagttcttttatttttatgttccctatgtcgattggtatggcagcgacgattctagttggacaagcgttgggtacaggttctccacaaaatgcgaagaaaattggctatgccgcattattattagggctaacggtgacgattattactgcattaattacgattttcttccgttatgaaattgcctctattttcgtaaccgatgaaattgtcatcgcaatggcggcaaatttattattatttgccgcactttatcaattttcagataccattcaaatggtggttggtggcattttacgtggctataaagataccaaaatgattttatacattacccttttttcttattgggtaattggtgtgccacttggttacacactcggtcgtacagattggcttattccacatattgatgcgaaaggtttctggattgcttttgtggtctcactcacttttgcggcgttcttactttctttgagaatgaaaaaaatgcaggccatgagcgataacgccattttacaacgtttagaaaaacttaaataa

SEQ ID NO: 2041 - DNA, 717 bp, H. influenzae strain 86-028NP
atgcaacttccagctttacaatcggcaaaattaattcgtcgttacaaacgctttcttgcggatattgaactaccaactggtgatgtgatgacaattcattgcgccaatacaggtgcgatgactggctgcggtgaaaaaggcgataccatttggtattcacattctgatagccaaacccgcaaatatccccattcttgggagctcacacaacttgcaaatggacaactttgttgtatcaatacgcatcgttctaatcagcttgtctttgaagcattgcaaaataaacaaatcaaagaattagcaatgtatgatgaaatttatcctgaagtgaaatacggcgaagaaaatagccgaattgatttcttactaaaaggcgagggtttgcctgattgttatgtagaagtgaaatcaatcacgcttgtaaaaggtaatttaggtatgttccccgatgcggttactacgcgtggacaaaaacacgttcgtgaattactcgcaatgaaaaaacaaggtcatagagcagtggtgctatttgctgggttacataatgggtttgatcgtttcaaaatcgcagaatatatcgatcctgaatatgatcgcttattaaaagaagcaatggaacaaggcgttgaagcctatgcttatgcgggacaatttgaaatttctaatgaaattcctaccgcactttctttgacagaatcggtgccttatataaaataa

SEQ ID NO: 2042 - DNA, 1188 bp, H. influenzae strain 86-028NP
atgactaacattaataccgttctcgcggaactaaagcgtggtactgatgaaatcctttcagaagcggatttaatcgaaaaactgaaagaaaatcgcccattaaaagtaaaattaggcgcagatccaaccgcaccagatattcatttaggacatactgttgtattaaataaattacgtcaatttcaacaactcggtcatgaagtctatttcttaattggcgattttactggaatggtgggcgatccatcaggtaaaaatgcgactcgtcctccacttagccgtgaagatgtattgcgcaatgcggaaacctataaagagcaaatttataaaattctcgatccacaaaaaaccaaaatcgtcttcaactctgaatggttaagcaaacttggtacagaaggtatgattcgtcttgcaagcaactatacggttgcgcgtatgcttgaacgcgacgacttcaaaaaacgctttggcaacaaccaacccattgccatccatgaatttatttatccattactgcaaggctacgattccgttgcattagatgcagatgtagaactaggcggtacagaccaaaaattcaacttacttgttggtcgtgaattacaaaaatcagcaggcaaaaaaccacaggttgcgattacactcccattactcgttggattagacggcgagaaaaaaatgtctaaatcacttggtaactatattggcgtaacggaagcaccaagcgatatgttcggtaaagtgatgtcaatttctgatgaactcatgtgggattggtataaccttctttcatttcgtccattaagcgaaattgcacaattaaaatcggaagtagaaaagggcaaaaatccacgtgatgtaaaaatcttattagcaaaagaattaattgcacgtttccacaatgaagaggcggcaaacgctgcagaacaagaatttattaaccgtttccaaaaaggcgcaatgcctgatgaaatgcctgaatttacgttttctggcgaaattggtttagccaccttattaaaagaagcaggccttgttccttccacttctgaagcgattcgctctgctcaacaaggcggtgtaaaaatcaatggtgaaaaagtcgataacgtaaaagataatgcaccgaaaggcacaaatgtttaccaagtgggtaaacgaaaatttgcgcgtgtgactgtggaataa

SEQ ID NO: 2043 - DNA, 948 bp, H. influenzae strain 86-028NP
atgcctgacattaaactcttcgcgggtaatgctacacctgaacttgcaaaacgtatttctgaacgtttatatatttcactaggcgatgcaacagtcgctcgtttcagcgatggagaaattcaagttcaaattaatgaaaatgtgcgtggtgcggatgtatttatcatccaatcaacttgtgcgccaaccaatgataacttgatggaattggttgtgatggtagatgcgttacgtcgcgcatctgctggtcgtattactgccgtgattccctatttcggctatgctcgccaagatcgtcgtgttcgttctgctcgtgtgcctattactgctaaagttgtggcagatttactttcaattgttggtattgaccgtgtcttaacctgcgacctacacgcagaacaaatccaaggtttctttgatgttcccgtagacaacgtatttggttcgccagttttaattcacgatattttgaaaaaatctgatcttgaaaatccaattgttgtttccccagatattggcggcgttgtgcgtgctcgcgctgtcgctaaattattaaacgatacggatatggctattattgacaaacgtcgccctcgtgcaaatgtagcacaagtgatgcatattatcggtgatattgcagaccgtgattgtattttggttgatgatatgattgatactggcggtacgctttgtaaagcggcagaagcattaaaagaacgtggtgcaaaacgtgtttttgcttatgcaactcacgccgttttctctggtgcagcagccaaaaatttagccagcgatgccattgatgaagttgtagttactgacacgattcctctatcagaagaaatgaaagcgatcggtaaagttcgcgtgcttacgctttcttccatgctggcagaagccattcgccgcattagcaacgaagaatctatttctgcgatgtttaactaa

SEQ ID NO: 2044 - DNA, 954 bp, H. influenzae strain 86-028NP
atgaatacattaatgaaatcacatcaattttctaccgcactttgccaaaatacaacacaatcaaatgggcagccattacgcttccctagccctgccaaactgaatttatttctttatatcaatggaaaattgccgaacggctatcatgaattacaaacgcttttccaatttttagattttggcgattggttagacattagtattcgggaacaagataatcaaattgttttaacgccagaaattccaaatctaaaaacggaaaataatctaatttatcgagctgcaaaacttttacaagaaaaagccaatattcaattgggtgcaaatattcatttagataaaattcttccaatgggaggcggtgttggtggcggttcatccaatgcagcaaccgcattagtctctttaaattatttatggcaagccaatttatccattgatgaactggcaaaattgggattaacattaggcgcggatgtgccaatatttgtatacggacaggctgcttttgctgaaggcgttggggaaaaaatcacttattgtgaacctgccgagaaatggtttgttatattaaaacccgatgattcaatatcgacggctgtcatctttcaagatccaaatttaccacgtaatacaccgaaaaaatccctcgaacaacttttgagtgaaccttataaaaacgattgcgaaaaagttgtgataaatcattattcaaacgttgaaaaagcgttaaactggttgctacaatatgcgccggcaagattaacaggaacgggagcctgtgtttttgctgaatttgatcatgaagcagaagcgcaagcggtatttagacaaaaaccagaagcattttttggtttcgtcgctaaaggactcaatgtgtctcccttgcacgcaatgttgaagcagctatcatcaactcatactcatcgacaatctaaacctgaggttttataa

SEQ ID NO: 2045 - DNA, 630 bp, H. influenzae strain 86-028NP
atgaataatatgaaaacgtttaaatttctcaccgcactttttgccactgcgattctaaccgcttgcacattagatatggaacgtcctactaatgtacaatacattgataaaacggatgcgatatggcaacaacatttacaaaagattcaaaaaattcaatcctatcaagccaaaggacaaattggttatatcagtcctacagaacgtttttctagccgctttgaatggcaataccaaaatccaaaatcttatacacttaaactctattctttaatcagtaaatctaccctgttgattcaaatgcatcaaagtgggatgacaatttccgataacaatgacaatcaacaatctgcagccaatgctaaactactattacaagagatcattggcatggatgtgccattagaacatttagcttattggttgaaaggccaaccagcaatgaacgcggattatcaagtgggtaccaaccatttacttggtgcatttacttatcatgtggatggttctcaatggacggcagattatctaacctatcactcaaataattcgatgcctgaaaatattttgctgaaaaatgacagcacaaaacaaaccttaaaaattcgcgtagacgagtggatttactaa

SEQ ID NO: 2046 - DNA, 1251 bp, H. influenzae strain 86-028NP
atgaaaatttatttggttggtggggctgttcgcgatcaattattggggttaccagtaaaagatcgtgattggattgtggtaggcgcagaccacgctacgctactctctctcggttatcagcaagtaggcaaagattttccggtttttctcaatcctaaaacaaaagaagaatatgcgcttgcccgaacagaacgtaaatctagcgcaggttacactggctttatttgtgatttctccccaacaatcacattagaacaagatttaattcgacgagatctcactattaacgcgatggctcaaagcgaagacggtgaaattatcgatccttatggcggaaaacaagatttagaaaatcgaattttacgccatatttctcccgctttttcagaagatcctttacgagtattacgcgtggcacgctttgcagcccgttatcattctctcggttttaaaatcgcctcggaaacattagctctaatgacagaacttgccctatcgggagaattacaacatctcacggcggaacgcgtttggctagaaacagaaaaagccttaaacgaaaaaaatcctgaaatttattttgaaaccttacataaaacaggcgcattaagcgttttattttctgaaatcgatgcccttcatggggtgccaaatccagtaaaacatcatcccgaagtggatagttttattcataccatgttggtattaaaacaagcggttaatttgactgaaaataaccctatcctaaataaaagtgcggttcgttttgcggctatttgtcatgatcttggcaaggctcttacacctcaaaatattcttcctcatcattatgggcatgaacaagctggcataaaaccgactagatcattgtgcaaacgcttgaaggttccaagttattttcaagaacttgcagaactgacttgtgaatttcacacgcatattcacaaagcctttgagcttcgagctgaaaccgtcataacgctgtttaatcgttttgatgtgtggagaaaaccacaacgctttcaagaatttctacaagtatgtttagctgatactcgaggtagaacaggttttgaaactaaagactatccacaaatagattacatcaatcaattattacactctgcaaatgaagtagatgtacagcaagttattgctgatggatttgagaaacaagcaatcaaaaatgaattgacgaaacgaagaatcttagcggttaaacaaacaaaaacgaattacccaacaaattaa

SEQ ID NO: 2047 - DNA, 612 bp, H. influenzae strain 86-028NP
atgaaaaagatctataaagccttaatctcatctttacttttaagtacatcaataaatgttgcttatgcggaaacccaatatgttactgaaaatttaagtactttcttacgtcgtggtgctggcgaacaatttaaaattgcaggttcaattcaagcaggcgaagcggtgaatgtattagaacgccaaggcaaatacacactcattcgcgacaataaaaatcgtgaagcttggattttaaattcagacttaagtagcacgccaagtagtaaagaagaaaatccaaaattaaaagcgcaagtccaagaattaaccttaaaacttagtcgtttagatggcgattggcaacaacgtaccgtcgaaatgcaacgtcgaaccaaacaagctgagcaacaaagtgcggatcttttagagcaaaattctcaacttaaacgtgaacttgaaatgaccaaaaataaaaatcgtgatttagaagcgatacttgatgcaggtaaacgagaaattgcgatccaatggtttatttatggcggttcagtattgggcgtaggcttactcttcggcttgcttattccttatgtattaccaaaacgtcgccgtcgtgatggttgggcataa

SEQ ID NO: 2048 - DNA, 1263 bp, H. influenzae strain 86-028NP
atggaaattattagtcaatatggttcttggttggtgtggatcacagcagcctttggcttttttatggcgttcggaattggagcaaatgatgtctcaaactcaatgggtacatccgtaggatctggtactgtaacagccaaacaagcaattattattgcgttaatttttgaatctgcaggtgcatatttagctggtggcgaagtaacacaaaccataaaaagtggcgtaatcgacccaatacaatttgttgatacacccgatattttagccttaggtatgctttcaaccttatttgcatcaggtgcttggttatttattgtaaccaaaatgggttggccagtttctggtatacacactattattggtgcaattattggatttgcctgtattacgattggccctagttctgtagattggtcaaatattggcagcatcgttggtagctggtttatcacgcctgtcatctcgggtattttggcttatgcaatctttgcaagtacgcaaaaacttatttttgatactgaacagccattaaaaaatgcacaaaaatatggcccttattatatggggataaccgtgtttgtactttgtatcgtgacgatgaaaaaaggcttaaaacacgtaggcttaaatctttcaaacagtgaaactttaatcatttcacttgccatcagtcttatcggaatgtttttcttccatttctattttaaaagcaaaatcttcactcaatcagcaaacaaaggcacttttggtgccgtagaaaaagtcttcagtattttaatgttattaaccgcttgtgcgatggcatttgcgcacggttctaatgacgtagccaatgcaattggccctctttctgcagtggtctctattgtaaatgaaggcggtaaaattgtttcaggtggagccttaacttggtggattttacccttaggtgcattaggtattgctgtgggcttaattactatgggacaaaaagtgatggcgactgttggatctgggatcaccgatttaacgccaagccgtggctttgctgctcaatttgctactgcaatgactgttgtagttgcatcaggcacaggcttacccatctcaacaacacaaacacttgttggagctattttaggtatcggttttgcacgtggtatcgctgcactgaatttaacggttatccgaaacatcattagttcttggattgtcacattaccagcaggcgcatttttcgccattattattttctatgtgctaagaactatctttaattaa

SEQ ID NO: 2049 - DNA, 681 bp, H. influenzae strain 86-028NP
atggcaatgaataatattctcggattatttgcccattcgcctctcaagccgttacaaaaacactctgaaaaagtgaccgaatgtagcgatcttttgattcctttttttcaaacgactttctcaaagaattgggaacaagcggaagaaaaacgcttagaaatttctcaatgcgaacgtgaggcagatagtttaaaacgcgaaattcggttgaaattgccacgtggtttattcttacctatcgatcgtactgatcttttagaattagtcacgcaacaagataaacttgccaattatgccaaagatattgcaggccgtatgattggtcgtcaatttggtattcctgaagaaatgcaggaagaattcttacattacgtaaaacgtagtttagatgcaattcatcaagcccaccgagtaatcgaagaaatggataagctattagaaacgggttttaaaggtcgtgaactcaaattagtcaatgatatgattcaagaacttgattcaattgaagatgatacagaccaaatgcagatcaaattgcgtaaaatgctttacaccatcgaaagccgttataatccaattgatgtaatgttcttatataaaattattgaatgggttggcgttttggctgaccaagcacaacgagtcggttcgcgcattgaattaatgctggcgcgttcataa

SEQ ID NO: 2050 - DNA, 456 bp, H. influenzae strain 86-028NP
atgaaggattgtaagatgcaaagtatcggcagtggcgtaagtttattgattttacgcttttttcttgcgtgggagttttttgaagcaggattagaaaaatggaatggacaaaattggttcgctgaaatacaagatcgttttccttttccatttaatcttattccagctgatattaattggcacgttgcaatgggatcagaattaattttcccatttttgctgatatttggagtgctaacacgttttagtgcattaagtttaacgattttaatctctgtcgcgtggtatagcattcacgccgattcaggttataacgtatgtgataatggttataaattaccattaatttatgtggtgactttattaatcttaattacacagggagcggggaaactctctttagacacgcttattaagaaggtttatccaactaaaagctggttgaaatttctctaa

SEQ ID NO: 2051 - DNA, 288 bp, H. influenzae strain 86-028NP
atgaaaaaattagcaacattaacagcattagcaagtgcattaacgatggcagtagcgacagcagtacaggctgaatcaaagtcaagcaatactgataatacagcaacaccttgtgtaggcgataaatgtgtcaaaacgaaagccgcagaaggtaagtgtggtgaaggcaaatgcggtgcagataaagctaaatctgctgaaggtaaatgtggcgagggtaaatgtggtgcgagcaaaccgaaagctgctgaaggcaaatgtggcgaaggtaaatgcggttctaaataa

SEQ ID NO: 2052 - DNA, 954 bp, H. influenzae strain 86-028NP
atgccagcttttattaaaaaggagttaattatgaaattacaaggcgctggactaggttatcgtcggaatttagctgaggattttttacaacttccctcaaataacgctattcaatttattgaagtcgcaccagaaaattggagtaaaatgggtggaatggcacgttatcaatttgatcaagcagcagaaagatttccgttagcagtacacggtctttcactttctttaggtgggcaagcaccacttgatcgcgaattactccgtaatacgaaagcattaattaatcaatataattcgtctttcttttctgaacatttaagttattgtgaatgtgaagggcatttatatgatttattacctatgccatttacagaagaagcagtaaaacacgttgcacaacgaatacgtgatgtgcaagatttcttaggattacaaatttcattagaaaatacttcttattatttgcattctcctactagcacaatgaatgaagtggaatttttaaatgctatcgcacaagaggctgattgtggcattcatttagatgtgaataatatttatgttaatggtgttaatcacggattgcttgatccttatatctttttagatcaagttgatgttaaacgtgttaattacattcatattgcagggcacgatgaagaacattctgctgcacaagttgtagagaattcagcaaatgaatcatttaataaagtaaaaggagcatatcgccatttacctgaattattaattgatacacacggagaagctgtaaaaggcactgtatgggatttactcgaatatgcctatcaacgactacctacgattcctccaacattattggagcgtgatttcaacttcccaccatttgcagaactttacgccgaagttgagcatattgcacaattacagcaaaaatacgctcacacagaggtaatgtcttatgcagcctaa

SEQ ID NO: 2053 - DNA, 717 bp, H. influenzae strain 86-028NP
atgcagcctaagtcatcattgaaagaaactcagcaagcattggcaaatgctattcggttaggtaatgcagatcctttaaatggttatgctgaaagccgtttagcggtatatacacgtttagttcgtaataatgcttttggttttattgatcgttgttttgttgaagcaccattgcatattgagctagagtattggaaaaatgctaaagaaaattttgtgcaaaatggtaatgcccattctccttatttccaagatattgcaggagaatttctcttgttttgtcaagaaaaagagatatttgatacaaatatattggcattgatggattttgaaaatacacaattactcgcagaagtttctttagccaaagtgcctgaaaaatttgagtggaatagacatagcgtaatgcaattatctggtgcagcttatttaaaaagttatgaagttgattttttatcaagtgactttaaacaatttgatgatacgccaattcaagttattatatggcgtgatagtgattttaggattcagcaacaaatcctttcagagttagattactggttgttaagttatctacaagaacaaccaaattcattagaaaatgttttgtctgctcttaatacaatggttgaagatagtacgtcaataatcccattattagagcaagtatggatgaaatgggttacatctgaagtaatttaccccgaacaaagataa

SEQ ID NO: 2054 - DNA, 168 bp, H. influenzae strain 86-028NP
atgatgccttggatagagaccgatgcgatgcaacagcgtgtacttttcttaaaagcgtggctaagccaacgctatactaaaactgaactgtgtcagcagtttaatattagccgtccaacggcagataaatggattaaacgccaccaacagcttggctttgagggctaa

SEQ ID NO: 2055 - DNA, 117 bp, H. influenzae strain 86-028NP
atgcactgtagcttaaaagcggcgcttcaacctcaaaatagctttgaagctcaacagatattattcaaccaattcttacgagaatacaatgaagaacgttcacacgaaggcgtttga

SEQ ID NO: 2056 - DNA, 165 bp, H. influenzae strain 86-028NP
ttgcaccacaaaatcaccaatacccacaaaaaaacgacttgcatcaaaccccacaccgaatcagcaaaaaaacacgcgatgatttatgttgaagatttacaggtagagaatatgtctaaatcagccaaaggcacagcggaaaaacacggcaaaaacgtgaaatag

SEQ ID NO: 2057 - DNA, 1953 bp, H. influenzae strain 86-028NP
atgacaaaagaaaatttgcaaaacgctccacaaaatacgaccgtttcacttgtggaatcaaacaacaaccaaacttccccgcaaatgcttcaacaatcacccaaacctagcctattgcgcttggaacaacatatcgaaaaaaaagattatgagtttgcttgtcgtgaattaatggtgattctggaaaaaatggatgctaattttggaggcgttcacgatattgaatttgacgcacccgctcagctggcatatctacccgaaaaactactaattcattttgccactcgtctcgctaatgcaattacaacactcttttccgaccccgaattggcaatttccgaagaaggggcattaaagatgattagtctgcaacgctggttgacgctgatttttgcttcctccccctacgttaacgcagaccacattctcaataaatataatatcaacccagattccgaaggtggctttcatttagcaacagacaactcttctattgctaaattctgtattttttacttgcccgaatccaatatcaatatgagtttagatgcgttatgggcagggaatcaacaactttgtgcttcattgtgttttgcgttgcaatcttcacgttttattggtaccgcatctgcgtttcataaaagagcggtggttttacagtggtttcctaaaaaactcgccgaaattgctgatttaaatgaattgcctgcaaacatccttcatgatgtatatatgcactgcagttatgatttagcaaaaaacaagcacgatgttaagcgtccattaaacgaacttgtccgtaaacatatcctcacgcaaggatggcaagaccgctacctttataccttaggtaaaaaggacggcaaacctgtaatgatggtactgcttgaacattttaattcggggcattcgatttatcgcacacactcaacttcaatgattgcggctcgagaaaaattctatttagttggcttaggctctgagagtgtcgatgaaataggtcgagaagtgtttgacgagttttttgaaatcagtagcaataatataatggagagactgttttttatccgtaaacagtgcgaaactttccagcccgcagttttctatatgccaagcattggcatggatattaccacgatttttgtgagcaacactcggcttgcccctattcaagctgtagccttgggtcatcctgccactacgcactctgaatttattgattatgtcatcgtagaagatgattatgtgggcagtgaagattgtttcagcgaaacccttttacgcttacccaaagatgccctaccttatgtaccatctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatacattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgccttgaactccgtcgttacatcatagaaaacaacggcttacaaaagctttttacaggcgaccctcgtccattgggtaaaatactgcttaagaaaacaaatgaatggaaacgaaagcacttgagtaaaaaataa

SEQ ID NO: 2058 - DNA, 1638 bp, H. influenzae strain 86-028NP
atgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtctactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaa

SEQ ID NO: 2059 - DNA, 4629 bp, H. influenzae strain 86-028NP; identical to SEQ ID NO: 669

SEQ ID NO: 2060 - DNA, 1047 bp, H. influenzae strain 86-028NP
atgctacaagaaattgaattaaaattggcgatttcgccacaaataggtattgaattgccacaatatcttgcaaaatttacgattttagaacatcaaaatttatttttgggtaacacctattatgattatcccgatcattttcttgctaaacaaaaaatgggattacgtattcgccaagaagagcaagaacttacattaacgcttaaaaccaacggtaaagttgttggtggattgcatagtcgtccagaatataatttactattaaccgaaaaagaaacgccaaccaatgcccaattaagagagctttatccttttgaacaattacctcgttcttcactacaacctattttctccacagattttaaccgcactttttggttagttgaatttcaacaatccaaaattgaagtggcgttcgatcaaggcaaaattattgcaggcgaatctgagcaaccgatttgtgaaattgagtttgaattgaaatctggcaacgtgcaggatctttttgattttgtagaaaccttgccttttgaaagggatatttattttaatagtggaagtaaagcgaagcgaggttatttgctgggctcaaaacaatttttaacagattggttaaataaatggcgtgatttcttaaaagaagaacgagaagaaagtgcggtagatttttgtgtaaaatttaattccgtgttgaaaatggaacagaaacttttggaagaaaccttatccttttctcccgcactttttagccaagattttatgaaaacagtagagcgagttggggtattttttaatctttatcattattatgatgaaaatggaaaaatcctagaagcggtggcaacagagaaacaaaaagaaacgctattgctagctttgttagaaagcaatcagaaaatctttgctgaaattcgtgacttgattcgttttcatagtgaaaccaaagacaatgaaaaaactattgaaaaattgaccgcacttttgaaaagtcgagtttattttaagcgaatgatcaaattaatggaattatcttatgacctagggtag

SEQ ID NO: 2061 - DNA, 1377 bp, H. influenzae strain 86-028NP
atggctaaagccccgaaaacagcttatgtatgtaacgattgtggtgcagagttttctcgttggcaagggcaatgttcggcttgtaaagcgtggaatacaatcacggaagtgcggttaatttccacggcaaaatcaaaaaatgatcgttttagtggctatgcgggggaaactcaggcaaaaattcaaaccctttctgaaattagtttgcaagaaacaccacgtttttccagtggctttaatgaattagatcgggtattgggcggcgggatcgtaccgggcagtgcgattttaattggtgggcatcctggtgcagggaaaagtaccttgttattacaagttatgtgtggtttggcgaaaaatatgaccgcactttatgtgacgggagaggaatcgttacaacaggttgcgatgcgtgctagtcgattgggattgccaaacgatcaattaaaaatgttgtcagaaacctctgtggaacagatttgtaatttgtcggatcagttaaaaccgcaaattatcgtggtggattctatccaagtaatgcatttggcagatattcaatcatcgccaggcagtgtagctcaagtgcgtgaatgtgcttctttcctcactcgttatgcgaaaactcgccaagtggcgattattatggttggacacgttacgaaagacggaacccttgcagggcctaaagtgttagagcatgccattgactgttcattattattagaaggcgaagccgattctcgttatcgtactttgcgtagccataaaaaccgttttggtgcagtcaatgaattaggtgtatttggaatgacagagcagggtttgcgcgaagtgaaaaatccatcggcgatttttttaagtcgcggagatgaaattacgtcaggcagttctgttatggtactttgggagggtactcgtcctcttttagtggaaattcaagccttggtggatcattcaatgctggcaaatcctcgccgtgttgcggtgggattagagcaaaatcgtttgtcgttgttattggcggttttacatagacacggaggtttgcaaatggcggatcaagatgtctttgtaaatgtcgttggtggtgtaaaagttagtgaaacaagtgcggatttagccttattgcttgcgttaatttctagtttccgtaatcgccctttgccacaagatttagtgatctttggtgaggttggattagcgggagaaattcgtccagtaccaagtggacaggaacgtattagcgaggctgcaaaacacggttttaaacgcgccatagttcctttcggcaataagccgaaaagtgcggtcgaaaatatgcaggtttttactgtgaaaaaactcacagatgcgctcgctgtgttagataatttataa

SEQ ID NO: 2062 - DNA, 501 bp, H. influenzae strain 86-028NP
atgtgcaaagaaataaagaaaatggaaaaaaaacgaaataaagcattggatgcgatagatataaaaattctgaatgaattacaacgcaacggtaaaatttccaatatcgatttgtcgagaaaagtggggctttcgccaacgccttgtttagaacgcgttaaacgtttggaaaaacaaggtgtgattatggggtatcgcgcactgttaaatccagaattattggatgcaccattgctagtaattgttgaaattacattagtacgaggtaagcccgatgtgtttgaagaatttaatgcggcgattcaagagttagatgaaattcaagaatgccatttggtatcgggcgattttgattatttattaaaaactcgtgtggcagatatggctgaataccgaaaattgctggggacgacattattgcgtttaccaggtgtaaatgacactcgcacttatgttgtgatggaagaagtaaaacaaaccaatttccttgtattgaaataa

SEQ ID NO: 2063 - DNA, 2757 bp, H. influenzae strain 86-028NP
atgattaaacaaattacagaacgatttacgccaagacagtatttagctgaatttttgctaggattgaccgcactttttggattttatttgattgttgcttggtcaagttatacgccccttgataattcttgggctacagccagcgcgtatggaaacacaattaataaagtggggacatttggagcgtggataatcgatcttttttttgttttttttggctatgtcgcccatattattcctttcaccgcttttctcgtgcctatttatttattgaaaacaaaagcagttaaacagctttcctgtactcgaattattttacgtagttttggctttaccatgctgattattgggctttgtgtagtgagtatgttgcttttatcaagtaatactttttatttgagtggcggcgtattgggcggatcgcttgttgtaaattggttttatcctgtattaggtaaatttggttcaattttaattggttttgtgcttgctttaattggttttattttttgttctggcgcatcattaattcgattaattgttgcattttatcattggctaacaatgaaaaatgagcaatcagaaaatgctgagcaagaaaaatcaacggaagaattagagcaaattgtgattgtaaaatcagatcgttcagaaacagaaaatctagatcaaaatcatctcaatgtagaacaaaatagtgagattgaaactcaaaaatcatctttagaggcagaagaaagctcagttgagcaaccttcgcatttaattaatattcatggtttaaatccagaggtttctataaaatcagaatatgaactcgctaacgaagatagtgaaaaaccgcaattttcttttgggtttgattctgaaagcttgcctagtgtgaatttatcgagtgattcagatgaacaaagagtgagtaaaaatgattttgtagtagtttggaataagcctgtaaaaacagttgttcaagaagatctagcaattaatcaaagtgcggatgattttacgcaagtttctttgctgacaaatgatgaaatgccaacagtttcattaaaatcaacctctgatactgaaatggcagataatcattttgctgctcaagttgatgaaaaggtagatttagaaaaagatgaagtgaaatttagcgtatctttacagaataatgtgggcgtaattgaattagacaaaaatcaagagcctaattataaaggttacagtggtagtttgattcatcctgcatttcaacagcaaacaacaaaacgtgaaaaaccgagtacaccattacctagtttggatttgcttttaaaatatccgccaaatgaacaacgtattacaccagatgaaataatggaaacctcacagcgtattgaacaacaattacgcaattttaatgtgaaagccagcgtaaaagatgtgcttgttggccctgttgttacgcgttatgaattagaattacagcccggtgtgaaagcatcaaaagttacgagcatcgataccgatttagcaagagcattgatgtttcgttctattcgcgtggcagaggttattccaggtaaaccttatattggtattgaaaccccaaatcttcatcgtcaaatggtgccattacgtgatgtattagatagcaatgaattccgtgatagcaaggcaactttacctattgctttaggtaaagatattagtggtaaaccagttattgttgatttagcaaaaatgccacatttattggtagcaggttctacgggatcaggtaagtctgttggtgtgaatacgatgattctcagtttactttatcgtgttcaaccagaagatgtgaaatttattatgattgatcctaaagtcgtcgaactttctgtttataatgatattccacatttactgacaccagttgtaacggatatgaaaaaagccgctaatgcgttgcgttggtgcgtagatgaaatggaacgtcgttatcagttgctttcagctttacgcgtacgaaacattgaaggctttaatgaaaaaattgatgaatacgaagcaatgggaatgcctgtgccaaatccaatttggcgaccgagcgatacgatggatgcaatgccaccagcgttgaaaaaattgagttatattgtggttattgtcgatgagtttgctgatttaatgatggtagcgggtaagcaaatcgaagaactgattgcacggttggcacaaaaagcgcgagctattggtatccatttaattttagccacacaacgcccctctgtggatgtgattactggtttaattaaagcaaatattccaagtcgcattgcctttacggtggcaagtaaaattgactcacgtactattcttgatcaagggggtgcagaagcccttttagggcgtggagatatgctttattctggacaaggttcatctgatttaatccgcgtacatggagcctatatgagtgatgatgaagtcatcaatattgccgatgattggcgagcacgcggtaaacctgattatattgatggaattttagaaagtgctgacgatgaggaaagtacagaaaaagggatatcaagcggtggagaattagatccactctttgatgaagtaatggactttgttattaatactggtacaacttcagtatcttctattcaacgtaaattcagcgtaggttttaaccgagcagcgcgtattatggatcaaatggaagagcaagggattgtcagcccaatgcaaaatggtaagcgtgaaattttatcgcatcgtccagaatactaa

SEQ ID NO: 2064 - DNA, 618 bp, H. influenzae strain 86-028NP
atgaaaaaaacaaccttaaaatttgccgcacttaccttacttggtttgagtaatttggcattggctgatgcggcaagtgaattacaaatgcgtttagctaaagtcgatgtattaagtgcagaatttgtgcaaacagtgacttctggaagtggaaaaaatgttcaacaaggaagtggcaaacttcaaattaaacgcccaaatttattccgtatggagactaaaacccctcaagaaacccagattatttctgatggtaaaaccttatggttctacgatccatttgtgcaacaagtgaccgcacaatgggtaaaaaatgcggtaaataatactccttttgttttgcttaccagcaatgataatagccattggcatcaatatacggtaacacaacaatcggatacctttgtgttaaaaccaaccttatccacaagcaacattaagcaatttgatattcgtgttgatgctaatggaatattgcgaaatttcagtacgacagagaaagatgggcaaaccaatctttatgttttacgtaatattacgaatcaaaccttgtctgatagcttgttccaattcaagccagaaaaaggcgttgaagtggatgaccaacgtaaaaaataa

SEQ ID NO: 2065 - DNA, 1341 bp, H. influenzae strain 86-028NP
atgtctaacctcaattttgattttgccgaaaatgattttcgcccactggcggccaagatgcgtccaacaaatctagaacaatattttgggcaaagccatttaattggcgagggcaagccactgcgaaaagctatccaagctgggcatattcattctatgattttgtggggcccaccaggtacggggaaaacaacccttgcagaaatcatagcacaacgtattaatgcagaagtagagcgaatttctgcggtgacgagtggtatcaaagaaattcgtgaagcgattgatcgtgcaaaacaaaatcgtcttgcggatcgtaaaactatcttatttgtggatgaagtccatcgttttaataaaagccagcaagatgcatttttaccgcacattgaagacggaaccgttatttttattggggcgacaacagaaaatccctcttttgagctaaataatgcgttgctttctcgtgcccgagtgtatgtgctgaaatcactcacaacggctgaaattgaacaagttttgcagcaagctgtagaagatcctgaacgaggattgggtaaagagcggttaattttagaagagaatttactgcaagtgcttgccgaatatgttaatggggatgcacgattagccttgaattgcctcgaattaatggtggatatggcagatgaaatggaaaatggaaagaaaattgaccgcactttattaaaagaagtcttaggcgaacgtcaagcgagatttgataaacaaggtgatcgtttctatgatttaatttctgcgctacataaatctgttcgaggttctgctccagacgctgcactgtattggtatgcaagaattttaacggcaggtggcgatcctttatatgtcgcgcgccgattacttgccattgcttcagaagatgtgggaaatgcagatcctcgtgctatgcaagttgcattggctgcttgggattgctttactcgagtgggggcttatgaaggagagagagccatcgcccaagccattatatatctcgcagtagcgccaaaaagtaatgcggtttatactgcatttaacacagcaaaacagcaagcgaaagatttgcccgattacgatgttccaccacatttacgcaatgcgccaactaatttaatgaaagagcttggctatggggctgaatatcgttatgctcacgatgaacctaacgcttatgcggcaggcgaaaattatttcccacctgaattaaaagatactcaatattattttccaacgaatagaggtatggaaattcagattaaggaaaaactagaacgattacgtgagcaagataaaagtacggtgaaaaaacggtataaataa

SEQ ID NO: 2066 - DNA, 1143 bp, H. influenzae strain 86-028NP
atgattttctctaaaaataagtatccacctttacatgaattcacggcattaatgaatagagtcgataattttcttaatcatgatgcagaaaatagaattgcatactataagaaacgtagtggtattgatttagaaaaagatgtatatgaggctatttgttattgtgctcaaaatactcctttcgaagacactattagtttagtatcagggaaacattttccagacattgtagctagtcaatattatggtattgaagtaaaaagtacacaaggagataaatggacttcaattggcagttctattcttgagtctacacgaattccaaatatagaaaaaattttcttaacatttggtaaattaggtggaaatattaaattcctatccaaaccatatgagtcgtgtttatgtgatatagctgtaacccattaccctagatataaaatagatatgttattagaaaagggggagagcatatttgaaaaaatggagaccacatatgattctctccgagaattagataatccaataactcctgtagctaaatactataaatctctattaatagaaggtgaaagtttatggtggacttcaaacaatgttttagatgatattgcccctcccaaagttagacactggaaggtaatagaaaaatatgagcgagatatgttaattgctcaagcatatgctttcttccctgaaacgatcttaggaaatcctagaaataaatatgataaattcgcactatggctagtgactaaacatggagtaataaacactagtttaagagatgagttttctgcaggagggcaacaaaaaataactgatacttgtggtgaaacacatctttgttctgctgtattaaagagagtagagaacaatattcttgcaattaaaaaatttattttagaaactcctgaaaatattctaactgaactttggggaaattacattaaagatgatcgtataactcaatgggcaaatttagtgttatcttattgtaaaccttcaaaccacaatgaaatgaaattaattttgacaaaaattgtaaatgaaaaaacaatttttaatgataaagatgatgtaaacaaattagaagaaatggcaaaaatatacataaccaatcagaaaattaatagtttataa

SEQ ID NO: 2067 - DNA, 1224 bp, H. influenzae strain 86-028NP
atgaaactaatatctctattctcaggttgtgggggaatggatatcggatttgaaggtagtttctcttgtctaaaaaaatctattaatgaggagctccaccctgaatggatcagctccacagaaaatgaatgggttaccgtttcgcccacttcttttgagacaatttttgctaatgatattaaacctgatgctaaagcagcatgggtttcttatttcttagaccaaaaagcgaatgcaaacgaaatctaccacttagaaagcattgttgatcttgtaaaaaaagaacgggaaactcacaatattttcccaaaagacattgatatattaacaggtggatttccttgtcaagatttttctgtagctggaaaacgattaggatttgattctcacaaaaatcatcatggaaaaatatcaaatatagatgaaccctcaattgaaaatagaggacaattatacatgtggatgagagaagtaatatctataactcaacccaaattattcatagctgaaaatgtaaaaggattaacgaaccttaaagatgtaaaagaaattattgaacatgattttggtcaagctagtgacgaaggatacttagttgtaccagctcaagtattaaatgctcagttttatggagttcctcaatcacgtgagcgtgtcattttttttggttttaaaaaaaatgcgctaaataaaaaagctttagaagaattacaaaaagaaaatattgctgaggattacaatccatatcctcccccaactcatggaaaagaaaatttgaaagctgttgttacatgcaccgatgcatttataaatctacaagaacccaattttagcaaagacccctctcaacaaaaatattcaaaagccaaatatatgggaaaccattgtcaagggcaggttgaaattaaacttaattctgttggcccaacaatccgatctgaacatcatggtaatattgaatatcgtagactaagcatagagcatggagggaaatatattaacgaattatctaaaggcatgctcgaacgtcgtcttactataagagaatgtgctagattacaaacgtttcctgatagataccaatttattttacctaaaacagcagaaaacgtttctgtttcagctagtaatgcctataaaattattggcaatgcggtaccatgtgtattagcttataatattgctaaaaatatagaaaaaaaatggaatctttattttaaatag

SEQ ID NO: 2068 - DNA, 1299 bp, H. influenzae strain 86-028NP
atggaaaaaattactcttgcaccaataagtgcggttgaaggaacaattaatttaccaggttctaaaagtttatcgaatcgcgcattacttttagccgccttagctaaaggaacaacaaaagtaaccaatttattagatagcgatgatattcgacatatgcttaacgcactgaaagcattaggcgtacgctatcaactgtctgatgataaaactatttgtgaagtagaaggattaggtggaacattcaatatacaggacaatctttcactctttcttggcaatgctgggactgcaatgcgtccattaaccgcagcactttgcttaaaaggaaaaaccgaaagcgaaatcatcttaacgggtgaacctcgtatgaaagagcggccaattctccatttagtcgatgctttacgccaagcgggtgcagatattcgctacttagagaatgagggttatcctccgctcgcaattcgcaacaaagggataaaaggtggaaaagtcaaaattgatggttcaatttcatctcaatttttgaccgcacttttaatgtctgcgccacttgcagaaaatgacacagaaatagaaattatcggtgaactagtctctaaaccctatattgacattacccttgcaatgatgcgagattttggtgttaaggttgaaaatcatcactaccaaaaatttcaagttaagggaaatcaatcctatatttcgcctaataaatacttggtagaaggcgatgcatcatcagcctcttactttcttgcagctggcgccattaaaggaaaagtgaaagtaacaggcattggcaaaaactcaattcaaggcgatcgtttatttgctgatgtattagagaaaatgggggcaaaaatcacttggggagaggattttatccaagccgaacacgctgaattaaatggtattgatatggatatgaaccacattccagatgccgcaatgacgattgcgaccaccgcacttttttccaacggcgaaaccgtcattcgcaatatttataactggcgtgtgaaagaaacagatcgtttaacggctatggcaactgaactccgtaaagtcggtgcagaagtcgaagaaggtgaagattttattcatattcaaccgcttccactcaatcaatttaaacacgccaatattgagacctataacgatcaccgtatagcaatgtgtttttctctaatcgcactatcaaacacacctgtgacgattttagatcccaaatgtactgccaaaacctttcctacattctttagtgaatttgagaaaatttgcttaagagattaa

SEQ ID NO: 2069 - DNA, 837 bp, H. influenzae strain 86-028NP
atgatcgaaaaaaaaatattactcactgattgccctgatgataaaggcttaatcgcaaaaataactaatatttgttacaaacatcaactaaatattcttcataataatgaatttgtagattttgaaaccaaacatttctttatgcgcacagaattggaaggtatttttaacgaagctactttattagaagatctaaaatatagcttacccgaagaaacgaattgtcgattaattggcacccaacgtaagcgaattgtaattttagtcaccaaagaagctcactgcctcggcgatattttaatgaaaaattattatggtgcgcttgatgtagaaattgcagccgtaatcggcaatcacgataatttacgtgaacttgttgaacgttttaatattccatttcatttagttagccacgaaaacttaacccgtgtagaacacgacaaattactggcagaaaaaattgatgaatatacgccagattatattgttctcgctaaatatatgcgtgtgctaaaccctgaatttgtcgcacgttatccaaatcgagtgattaatatccatcattcattcttgcctgcttttattggtgccaagccttatcaacaagcctatgaacgcggtgtaaaaattattggcgcaacggcacattttattaataacgaattagatcaaggcccaatcattatgcaaaatgtgattaatgtggatcatacttataatgcagaagcgatgatgcgtgctggccgtgatgtggaaaaaaccgtgttaagtcgcgcccttgatctcgctttacacgatagaatttttgtttataaaaataaaacggtggtgttgtaa

SEQ ID NO: 2070 - DNA, 405 bp, H. influenzae strain 86-028NP
atgaacgaattagtaagaggtttaacaaatcttcgtagtttacgtgcagctgtacgtgaattaacgttagaacaagcagaaaatgccctagaaaaattacaaacagctatcgaagaaaaacgtgctaatgaagcagaattaattaaagcagagacagagcgaaaagagcgtttagctaaatataaagaattaatggaaaaagaaggtattacacctgaagaattacacgaaatttttggcacaaaaactgtatcaattcgagcaaaacgtgctccacgccctgcaaaatatgcgtttattgatgaaaatggcgagcataaaacttggacgggtcaaggtcgcacaccacgcccaattcaaaatgcgttgaacaaaggtaaatcattatctgatttcgaaatttaa

SEQ ID NO: 2071 - DNA, 1560 bp, H. influenzae strain 86-028NP
atgctttccgttctctccattaattataggtattatttaatggaacttattgatttttcatcatctgtttggtcaatcgtccctgctttgttggcgataattttggcgatagcaactcgccgtgttttggtttcccttagtgcggggattattattggatcattaatgttaagcgattggcaaatcggcagcgcatttaattatttggtaaaaaatgtggtttctttggtttatgccgatggtgaaatcaattcaaatatgaacattgttttgttcttattattgcttggtgttttaaccgcacttttaaccgtatcaggtagtaatcgtgcctttgctgaatgggcgcaaagccgtattaaagatcgtcgtggtgctaaattattagcggcatcattggtttttgttacttttattgacgattatttccatagtctcgctgtaggtgcgattgctcgtcctgtgacagatcgttttaaagtttctcgtgcgaaacttgcttatattttagattcaacggcagcaccgatgtgtgtaatgatgccagtttccagttggggcgcatatattattactttaataggcggtttattagcgacttattcgatcacggagtacacaccaattggtgcattcgtagcaatgagttcaatgaacttctatgcaattttctccattattatggtgttttttgtggcatatttttcttttgatattgcttcaatggtgcgtcacgaaaaattagctttggaaaatactgaagatcagttggaagaagaaacgggtaaaaaaggtcaggtgcgtaatcttatattacctattttagttttaattatcgctacagtttcaatgatgatttacacaggcgcagaggcattggctgcggatggcaaagtgtttagtgttttaggtgcatttgaaaacaccgtagtaggaacatctttggttgtaggtggattctgttcaattattatttctactttattaattattcttgatcgtcaagtgagtgttcctgaatatgcacgttcttggattgtgggaattaaatcaatgtcaggtgcaatcgcaattttattctttgcttggacaattaataaaatagtaggcgatatgcaaacaggtaaatatctatcttctcttgtgtctggtaatattccaatgcaatttttgcctgttatactttttgttcttggtgcagcgatggcattttcaacaggtacgagctggggaacattcggtattatgttaccaattgccgcagcaatggcagcgaatgccgcaccagaattattgcttccttgtttatctgcagtaatggcaggggctgtatgtggcgatcattgctcgccagtatcggatacaacaattttgtcttcaacgggtgcgaaatgtaatcatattgatcacgttactactcagcttccttatgctgccacagttgcaacagcgacttctattggttacattgtggtagggtttacttattcaggtttagctggttttgcagcaacggcagtttcattgattgtcattgtatttgcagttaaaaaacgctaa

SEQ ID NO: 2072 - DNA, 150 bp, H. influenzae strain 86-028NP
ttgtcgcatttttttatttttattgatgtaaaaatttataaaaaactaaattttcatttatctttggttttttatatttttttaattgatttttttgttgttttagtggctagacaaattttttttactttgtatgatgtggaatattga

SEQ ID NO: 2073 - DNA, 1722 bp, H. influenzae strain 86-028NP
atgaagaagttatctggcgcagagatggtggttcaatctttacgtgatgaaggcgtagagtatgtatttggttatcccggaggcgcggtattagatatttatgatgcaattcatacgctgggtggtattgaacatattttagttcgccacgaacaagccgcggtgcatatggcggatggttacgcacgttcaacgggtaaagttggatgtgtgctagtgacttcggggcctggtgcaacaaatgctatcactggtattttaacggcttataccgattctgtgcctatggttatcatttcgggtcaggttatgagcaatttaattggcagtgatgctttccaagaatgtgatatgctgggtatttctcgtcccgttgtgaagcatagctttattgtcaaaaaggcggaagatattccatctactttgaaaaaagccttttatattgcatctacgggtcgtccaggccctgttgttgtggatattccaaaagacactgtaaatccgaattttaaatatccttatgaatatcctgaatctgtcgagttacgttcttataatcccacagtaaatggacacaaaggtcaaattaaaaaagcgttaaaagcacttttagtggcgaagaaaccaatactttttgtcggtggtggcgcaatcactgctgaatgtagtaagcagttaattcagtttgcacaacgtttaaatttaccagtgacttcctcattaatgggattgggtgcttatccaagtacggataaacaattcttaggtatgttgggtatgcatggtactttagaagcgaatacggcaatgcacgaaagtgatcttattttggggattggcgttcgttttgatgatcgtacgacaaataatttagaaaaatattgcccaaatgcaaaagtgattcatattgatattgatccaacctcaatttctaaaaatgtgccagtagcgattccaattgtcggaaatgcgaaaaatgtattggaagaatttttgggtttattgaatgaagagggattaaaatctcaaacggatcttgaaagttggtggcaagaaatcaaccaatggaaagcaaaaaaatgtttggaatttgaccgcacttctggcgtgattaaaccgcaacaagtcgtggaagcggtatatcgcctcacgaaaggacaagcttatgtggcttctgatgtaggtcagcaccaaatgtttgctgcgttacattatccattcgatgaaccgcgtcattggattaattctggtggtgcaggcacaatgggttttggttttcctgcggcacttggtgtgaaattagctcatcctgaaggaactgttgtttgcgttactggcgatggtagtattcaaatgaatattcaagagctttctaccgcaacgcagtatggtattcctgttgtcattatttgtttgaataatcatttcttgggaatggtaaaacaatggcaagatttgatttattctggtcgccattcgcaaacctatatgaattccttgcctgattttgcgaaattggcagaatcttacggtcacgtaggaataaaaattgctacccccgatgaacttgaaagcaaattgcaagaagcattcagtattaaaaataaattagtctttgtagatattaatgtagatgaatctgaacacgtttatccaatgcaaattcgtggtggagcaatgaatgaaatgattttaagtaaacctcaagaggagacaaactaa

SEQ ID NO: 2074 - DNA, 492 bp, H. influenzae strain 86-028NP
atgcgtagaattttatctgttttactcgaaaatgagtctggtgctttatcgcgtgttgttggtttattctcacaacgtgcctttaatattgaaagtttgacggttgcaccaacggatgatccaacgctttctcgaatgaccattgaagctgtgggcgatgctcaggcattggagcaaatcgaaaaacaacttcataaattagtggatgtgtttaaagtggttaatttaagtgagcaggaacatatagaacgagaaattgttttagcgaaagtaagagcagtggggtcatctcgcgatgaaattaaacgattagcagatattttccgcggtcaaattgtagatgtcacaccaaagtcttacacaattcaattaagcggtacaaatgataaagttgatgcgtttatttctgcattgaaagaagaaactacattgttagaaattgttcgttctggattgattagtgtgtctcgtggagaaaagaatattctttaa

SEQ ID NO: 2075 - DNA, 1734 bp, H. influenzae strain 86-028NP
gtgaatattcaatctattctatccgataaaattaaacaagcaatggttattgcaggtgctgatcaatcttgtgatgcgcttgttcgtcaatcaggcaaaccacaatttggcgattatcaagccaacggtattatggctgcagcaaaaaaattaggtttaaatccacgagaatttgctcaaaaagttttagataatcttcaactatctgatattgcagaaaaattagaaatcgcaggtccaggttttatcaatattttcttaaatccaacttggctaacaactgaaatttcagctgcactttcccacaaaaatttaggtattcaagctaccaataaacaaacagttgtgattgattattcctctccaaacgtagcaaaagaaatgcacgtaggtcatttacgctctacgataatcggcgatgctgtagctagaacccttgagtttttaggtcacaatgtcatccgcgctaaccacgtaggcgactggggaacgcaattcggaatgcttattgcttatcttgaaaaaatgcaaaacgaacacgccagtgaaatggaattacaagatcttgaagccttttatcgcgaagccaaaaaacactacgatgaagatgaaatattcgctgaaaaagcacgtaattacgtcgtaaaattacaaagtggagatgaatattgtcgaacgatgtggaaacgtttagtcgatatcactatgcaacaaaatcagcacaactataatcgcttaaacgtgactttaaccgaaaaagatgtaatgggcgaaagtctttataatcctatgttaccaagcatcgtagaagatcttaaaaaacaaggtttggctgtggaaaatgatggtgcattggttgtttatttagatgaatttaaaaataaagatggcgacccaatgggtgtaatcgttcaaaaaaaagacggcggtttcctttatactacaactgatattgctgcagcaaaatatcgttatgaaacattaaaagctaatcgcgcacttgttttttcagatactcgccaaagccaacatatgcaacaagcttggttaattactcgtaaagcaggttatgtaccagacagtttctcgttagagcataaaaactttgggatgatgcttggtaaagatggcaagccatttaaaactcgtactggtggcacggtaaaattagccgatctattaaatgaagccatcgaacgcgccactgtattaattaatgaaaaaaataccaatttatctaatgatgaaaaacaagctgtgattgaggctattggtattggatcggtaaaatatgcagatctatccaaaaaccgcaccacggattacgtttttgattgggataatatgttaagtttcgaaggtaacactgcaccttatatgcaatatgcctacactcgaattcgttcgatctttaataaaacagatataaattcaaccgcacttttggctgcacctttaactattaaagatgataaagaaagaacgcttgcaatcaagcttctacaatttgaagaagccgtgcaaactgtcggaaaagaaggcacaccacacgtgctttgtgcttatttatatgaacttgctggcatcttctcgtcattctatgaacattgcccaattttaaatgctgaaaatgaatctataaaattaagtcgtttgaaattggcattattaacagaaaaaaccttaaaacagggtttaacgttactcggtattaaaaccgtagaaaaaatgtaa

SEQ ID NO: 2076 - DNA, 570 bp, H. influenzae strain 86-028NP
atgacaaatttacaggaaaatttgaccgcactttcagcagatttagcaacatttgaaagaaaaattcagcatttagccaaagaaatgacaatagatctgtctcactatgaaatcgatcatcttgcattacgggtaaatagtgagcaaactgctaaaaattggctgatacttttattaaagtgcggtagaattttatctgataatattgttaatggtcgtaagatttatcttattgaattagaaaaaccagttaaatttgccaatcaatttgtggatattattgaacttccacttcctaaaaataaaaaatatccaattgaaggttgggaacatattgagattgtagtgccatttttaccgaatgaatcgataaatgaatggattgaccgtgttaatatgtattttttatggaacaaattaactcaattaaccattaaagtgagcgagcctaaggtggatggggaaagattaccaaatccatctattgcagtaagttttacggataaaacagtaaatcatacttgcattaaggttcatccttattctattaaaaaaatacttgaggtttag

SEQ ID NO: 2077 - DNA, 222 bp, H. influenzae strain 86-028NP
atgaaaatgcttaaaggtcaaatcgtttttagccaaatggaaggcgaaaatcttaaattaactattcgtaaaaatgattgttctggtaaccagcagaaaggagaggaagttattattgtgcataagtatgattcaactcttgctattggggcttgtgtgacggtgtctaataatagccaagtaaagaatatttcatcattttcgccaagaaatccattttaa

SEQ ID NO: 2078 - DNA, 465 bp, H. influenzae strain 86-028NP
atgaaaaagaaaacactagcattagctatcttaactatttttagtgtggctggatgtacgaatacagatatttttagtggcgatgtgtatagtgcatctcaagcaaaggaagctcgttcaattacttatggtacgattgtttctgtgcgtcctgttaagatccaagctgataatcaaggcgtaattggtacgcttggtggcggtgcgttaggtggtattgcgggtagtgcaattggcggtggtcgtggtcaagttatcgcagcagtagttggtgcgattggtggtgcagtagctggaagcaaaatcgaagagaaagtaagtcaagtaaacggtgctgaacttgtaattaaaaaagatgatggtcaagagatcgttgttgttcaaaaggctgacagcagttttgtagctggtcgccgagttcgtattgttggtggcggctcgaacttaaatgtttctgtgctataa

SEQ ID NO: 2079 - DNA, 972 bp, H. influenzae strain 86-028NP
atggaaaatcccccattagtatcggttattgtttgtgcttataacgctgagcaatatatagatgaaagcatttcatccattattaatcagagttataaaaatctagaaattatagttatcaatgatggttcaacagatttgactttgtctcatttagaagaaatatctaaattagataaaaggataaaaattatcagtaataaatataatttagggttcataaattctttgaatataggccttggttgtttttcaggtaaatattttgcaagaatggatgctgatgatatagctaaaccatcgtggattgagaaaatagttacctatctggagaaaaatgatcatattacagcaatgggatcatacttagagattattgtagaaaaagaatgtggcattatcggttctaaatataaaactggtgatatatggaaaaatccattgctacataatgatatttgtgaagctatgcttttctataatccgatacataacaacactatgattatgagagcaaatgtatatagagagcataaattaatctttaataaagattatccctatgcagaagattataagttttggtcagaggttagtaggcttggttgtttagctaattatcctgaagcattagtaaaatatagactacatggaaaccaaacatcatcagtttataatcataagcaaaatgaggtagctaaaaagataaagggggaaaatattacatattaccttaataagataggtatagatataaaagtaattaatagtgtgtcgttgctagaaatatatcatgtggataaaagtaataaagtgttgaaaagtatactttatgatatgtatatgagcttagataaatatactataacttcactcttacattttattaaatatcatcttaaattatttgatttaaagcaaaattttaagattataaaaaaatttatcagaaaaataaatgttatgttttag

SEQ ID NO: 2080 - DNA, 498 bp, H. influenzae strain 86-028NP
atgagagaaagtcgcttaagtcaatataagcaaaataaacttattgagatatttctggcaagtgtgacagctctagctgcagctaagttggtaaatataaataaacttcagcttattactttcatcgtctaccattatttatcactcaaagcagcctacatttggaaatgtttgaaggtgaaattcaagcgaatgaaagctattttggtggtgctctgaaaggtaaacttggtcaaggataagctggaaaaacttcgtaatttgttttttgaaacgaaatagcaaagtatacaccgtggtggttatgaatatgcaatctgcaacactgttactgattattcgagaaaaggtaaacaaggtagtattgtttatatgaatttctacagaggttatgatattcttaagctatttttaaaggaatatgaatggcgttttaatcacagtgatttaaaaaactcaaatttctattgtaaaacaattaatttaggagagttttaa

SEQ ID NO: 2081 - DNA, 1692 bp, H. influenzae strain 86-028NP
gtgcggttaaaatttcaattatttttaatgaaaggaaataccatgaaaaatattaacccaactcacacccaagcgtggaaatctctcgaagcacataaagctgaattatcaaacaccaccatccaagatttatttaaacaagaaaaaaatcgttttgacgattattctttaacattcaataaccaaattcttgtcgatttttccaaaaacaacatcaatcaaacaaccctttcacatcttcgccaacttgctcaagaatgcgcacttgatagtgcaaaagaagcgatgtttactggcgaaaaaatcaatcgtacagaaaatcgtgccgtgctgcatactgcacttcgcaatcgcactaatacgccagtacttgttgatggtaaagatgttatgcctgaagtcaatgctgtgttagctaaaatgaaagatttctgtcagcgtattatttctggcgaatggaaaggctatacaggcaaagccattacggatgtagtgaatattggtattggtggctctgacttaggcccttatatggtaaccgaagcacttcgcccgtataaaaatcatctaaatatgcactttgtttcaaatgtcgatggtacacatattgcggaaaccttaaaaaaagtcaatccagaaacgactcttttcttagtagcatcgaaaacttttacaactcaagaaaccatgacaaatgcacaaagtgcgcgtgattggttactaaaagcagcgaaagatgaaagtgcggttgcaaaacattttgcagcattatcaaccaatgctaaagatgtagaaaaatttggtattgataccaataacatgtttgaattttgggattgggttggcggtcgttactctttatggtcagctattggtctttcaattgcactatcaattggctttgaaaactttgaagcgttattaaatggcgcgcatgaaatggataaacatttccgcactactccaattgaaaaaaatattccaactactttagccttagttggtttatggaataccaatttccttggtgcccaaacagaagcaatcttaccttatgatcaatatttacatcgctttgcggcttatttccaacaaggtaatatggaatcaaatggtaaatatgtggatcgtgatggcaatgtcattaacaattaccaaacgggcccgattatttggggagaaccaggtacaaatggacaacacgcgttctatcaattaattcatcaaggcactactttaattccttgtgattttatcgcacctgctcaaagccataacccattggcagatcatcacaataaattgctttccaacttctttgcacaaacagaagcattagcattcggaaaaacaaaagaggaagtcgaggctgaatttgtaaaagcggggaaatctttggatgatgtgaaaaatattgttccatttaaagtatttacgggtaataagccaactaattccattctcgttcaaaaaatcacgccatttaccttgggtgcattaattgcgatgtatgaacataaaatcttcgtacaaggtgtgatttttaatatctttagcttcgatcaatggggtgtcgaactaggcaaacaacttgcaaatagaattcttcctgaattaaccgattctgaaaaagtcgcaagccacgatagttcaacaaatggattaatcaatcaatttaaagcatggcgttaa

SEQ ID NO: 2082 - DNA, 1083 bp, H. influenzae strain 86-028NP
atgaacgtaaaaccggcgacagcgaaaatcagttcgcacgccttaaaacaaaatttagaaataattaaacaaaaagcaccaaatagcaaaattattgctgtggttaaagcaaacgcttatggtcacggcgttgtgtttgttgcatcaactttagaacaaaatgtcgattgctttggcgtggctcgtttagaagaggctttagcattacgctccaacggcatcactaaaccgattttattacttgaaggcttttttaatgaacaagatttgcctattctagccgttaataatattgaaaccgtggtacacaatcacgaacagcttgaggctttaaaacgttcaaatttaccaagtccaattaaggtttggttaaaaatagatacgggaatgcaccgtttaggcgttgctcttgatgaagtggattatttttatcaagaactgaaaaaactccctcaaattcaaccgcacttaggctttgtcagccatttcagccgagccgatgaactagaatcagattacacccaacttcaaatcaatcgttttttatccgccacaaaagataaacaaggtgaacgcactatcgcagcttctggcggcattcttttctggccaaaatctcacttagaatgtattcgcccaggcattattatgtacggcatttctccaactgatactattggcaaagagtttggcttaacgccagtgatgaatttaacctcgtcattaattgccgttcgccatcataaacaaggcgatcctgtaggttacggcggtatttggacaagtccacgagataccaaaattggcgtggtcgcaatgggttatggcgatggttatccgcgcgatgtgccagaaggtacgcctgtttatttaaatggccgtctcgtaccaattgttggacgtgtgtcaatggatatgctcactgttgatttaggcgcagatagccaagatttggtaggcgatgaagtaattttatggggcaaggaattacctattgaaaccgtagctaaattcacaggcattttaagctacgagctaattacaaaattaacacctcgtgttataactgaatacgttgattaa

SEQ ID NO: 2083 - DNA, 1515 bp, H. influenzae strain 86-028NP
gtggatttttccaccgttttttatttccttttttcaccgcacttttcacttaaatccaatagatatttgcggtatcataggcgacattctagtatcgaaataagtcctatggcatcacaacctcaaatcaaatcttcagacaaaaaaacagcacaagttagcattcctccgcactcaattgaggctgaacaagccgtgttgggtggcatcatgctgagcaatcaacattgggatggcattgctgaacgtgtgattgctgacgatttttatacttttcagcatcgtctaatttttacagaaatggaacatctaatgcgtaatcaatcgcctattgatttaattacgctagatcaagccttaagaagccacggtgtcagcgatgaagtaggtggatttgcctatctagcagagctttctaataatactccgaacgcgattaatattttggcttatgcagatattgtgcgtgagaaagccatattacgagaacttatttcggtaggaaatcgcattgctgaaaatagctattctcctaaagggcaagacattaagttaattcttgatgaggctgagcgtgaagtatttgcgattgcagaaaaacgaacaacttctagcgaaggcccacaaaatgtgatcaatgtgctagaaagtaccattgaaaaaatcgatattttaagcaaacttgaaaatcattcaggtgtaacaggtgttacgacgggctttaccgatcttgataaaaaaacggctggtttacaaccttcagacttaattatcgttgcggcacgtccgtcaatgggtaaaaccactttcgccatgaacctttgcgaaaatgccgcaatggcaagtgaaaaacccgttttagtatttagtttagaaatgccagcagaacaaattatgatgcgtatgatcgcatcgcttgctcgcgttgatcaaactaaaatccgaacaggtcaaaatttagatgaaatcgagtggaataaaattgctagcgtagtgggaatgttcaagcaaaaaaataatctttttatcgatgattcttcaggtctaacacctaccgatgttcgttcgcgcgcacgccgagtttatcgtgaaaatggtggattaagtatgattatggtggattatttgcaattaatgcgcgcacccgcattttcagataaccgaacactagaaatcgcagaaatttctcgttccctcaaagcactcgccaaagaattacaagtgccagtagttgccctttctcagttaaatcgtactttagaacaacgtgcagacaaacgccctgtaaattcagatttacgtgaatcaggctctattgaacaagatgcagacttgattatgtttatttaccgagacgaagtctataacgataactcggaagataaaggcgttgcagaaattattatcggtaaacagcgtaacggcccaattggtcgagtgcggttaaaatttaatggacaattctcacgctttgacaatcttgccgaacaacgtgaatatcgagatgattattaa

SEQ ID NO: 2084 - DNA, 1437 bp, H. influenzae strain 86-028NP
atgtctagaagactaagaagaacgaagattgtatgtactatgggcccatcaactgaccgtgataacaatcttgaaaaaattatcgcagcgggcgcaaacgtagttcgtatgaacttctctcacggtacacctgatgaccatatcggacgtgctgaacgtgtacgttctattgcgaaaaaattaggtaaaaccgtggcaatcttaggtgatttacaaggtcctaaaattcgtgtttctacttttaaagacggtaaaattttcttaaacgttggcgataaattcattcttgatgcagaattaccaaaaggcgaaggcactcaagaatccgttggtttagactataaaacgcttcctcaagatgttgtgccgggcgatattcttttattagatgatggccgtgttcaattaaaagtattatcaactgatggtgcaaaagttttcactgaagttactgttggtggtccattatcaaataataaaggtatcaataaattaggtggcggtttatctgcggatgccctaacagaaaaagataaagccgacattattaccgctgcacgcattggtgttgatttcttagccgtttctttccctcgttcaagtgcagatttaaattatgcacgtgaacttgctcaacaagcaggtttaaatgcaaaaatcgttgctaaagttgaacgtgcagaaaccgttgctaatgatgaagccatggacgatattattttagcatctgatgtaattatggttgctcgtggtgacttaggcgtagaaatcggcgatcctgaattagtcggtgtacagaaaaaattaattcgtcgttcacgtcaattaaatcgtgctgtaattacagcgactcaaatgatggaatcaatgattagtaacccaatgccaacgcgtgctgaagtaatggacgttgcaaacgcagtattagatggaactgatgcagttatgctttctgcagaaacagcagcaggtcaatatccttctgaaacagtggcagcaatggctagcgtatgtttaggtgcagaaaaaatgccaagcattaacgtttctcgtcaccgtatggataaagaatttgaaaccattgaagaatctgttgcgatgtctgcaatgtatgcagcaaaccacatgaaaggtgtagcggcaatcgtcactttaactagcacaggccgtactccattattaatgtcacgcattagctctggcttaccaatctttgctttatctcgtaatcaagaaaccctaaacctttgtgcactataccgcggtgtaacaccaatttatcacggtgaagaaagtcgtacagaagcaggtgcaaaagcagcacttcaatcattaaaagaaaaaggttatttatctactggcgatttagtactggtaacccaaggtggtcaaggtgcgacacaaactaacgtatgtcgtacattaattgttgaataa

SEQ ID NO: 2085 - DNA, 1260 bp, H. influenzae strain 86-028NP
atggggggaaggatggctgtattagtgaaaccattaagcattacagaaatcaataatgctaaacctaaagagaaagactactcactgtctgatggccaaggtcttttcttgctcgtaaaaatgaatggttcgaaaatttggcgatttcaatattataaaccaatttctaaaaaaagaactttaattagtcttggtgtttatcctgagatttcattgaaagatgctcgagagattagggatttatatcgttctttgttggcgaaaaatatcgatccgcaagattatcgtttacagcaagaacaaaaagccatccaagaacgtcaatttaccttgagcgaaatggggaaggaatggctatacctaaagaaaaatgaagttgatactgggcgattaaaagaagtgacttttattgatattgggaaacggttagaacgtcacttgtttaaagtgttggggcattattctattagtgagatttctgctcctcttgctattgagaaattaaaaccattagaacgagcaggaaaattggatacattgcatcgtattattggttatttaaaccaaataatgatttattcggttaatagaggggtaattaattataatgcaaccgcagatattggaagggtatttattcgaccaatagctgaaaataaccctactattcgcccagagcaattacctaaattgtttgaagatttgcagaatagtacccttgaaattgaaactcgttgtgcattagagctactactacttaccgcaggtcgggctggggctattactcaattagaatgggaaaatgtagatttcgaaaacagcttattgaatataccgaaagaaaaaatgaaggggcgacaaggtaaagtacaagattttatcttgccattatccaaacaagctgtaacgattttgcgcttgttacagaagttgaatcgttgcaatagtaagtttgttttccctagcaaaaaaaatccaagacagcctatatcgaaagagacgccaaataaagcacttggacggatcggttataggaatattttgaccgcacatggtttacgatctgtttttagcacagctatgaatgaggccgaatttaacagtgagattattgaggtgtgcttggcacattttgaatattcttccgttcgtggcacatacaataaagcaaagtatatgccacaacggatcgaatatatgcagtggtgggggaattttgtagaagaggcatctgatgggaaagcattaatgggctgttaa

SEQ ID NO: 2086 - DNA, 270 bp, H. influenzae strain 86-028NP
atgagtgaaaataatggctggattaattgtgcaaacgaactaccagaaccattttctaccgacttagagtatcgtaatgcaactaacaaacacctaatttattttactgaggatggtgatcattgggctgttggtcttggctggtatttatatgacgataagtcggattgtgaaggttgtttaattccgtattgggaatcggatgaaaaccctggcgaggaagtggaggttatttattggcaaccgctaccacaaccaccggaggaataa

SEQ ID NO: 2087 - DNA, 171 bp, H. influenzae strain 86-028NP
atgagcaatgaaataacccaaaaagtccgcataacaatcgaagttgaaatggacgactaccaacgtgatcaacttaaaatatcaaaaaatacgcaagtgttaggcggaaatatcgtgctattagactgggaaggtggtgtgtttgacgaagttgatgggtattgcatttga

SEQ ID NO: 2088 - DNA, 534 bp, H. influenzae strain 86-028NP
atgttcggagcggttgtcagggatgagaatgagattggggaagatatgaaagtgctagacgaacatatccttgagtatatctgggatgaaacattagaccgcatcgcacaacacaccttggtaacgtatatcggtggcagtgttggcacgtatagcgatgatcatgcagagaaaagagcagaagactttgcaatattgagtgtaagacaccttattgaaggctctggattaagcgaaagtcaatttagacggcgggttaaaaagcttatggcacaaggtgttttgttgcaacgcattgggccgaatagctttgtgattaactcggatgtggttaaagacgcagcggtacatgccgcacgatgttggcgcgcaatcggtgtgccgtatggtatggacgacaccgggagagcctgtaaaacattgcctattaacgctctgccgagaagcatttttgagttaaaaacaaattgttatcggattttgagatctgaatatccaagttacaaaggaaaaggagtaggaaatgagcaatga

SEQ ID NO: 2089 - DNA, 417 bp, H. influenzae strain 86-028NP
atggatattattaatttaatcaaacaacaaacgcctgaagaaagacaaacattattcaatgaatttattaaactcttaaaccaaaaaagagaatatgtagatattcctgaaagaattgtatgctctgcttgccaagtgtttgtagatgaaagagatggtacaaatgaagatggcggtgagattatccatgaagtatatggtttaagacactatgacccattcatgcgtaagcagattaaagaattagaaaaacaatacaagtatgctcttttagattgggaacaagggtttctaactaataaaggtcgttttgtaggtcgtaaagaagcaatggaaattgctaaagctcagaaccaagtaattcgtttatctggttcaccaaactcagatattctgttctcagaagatttatattag

SEQ ID NO: 2090 - DNA, 678 bp, H. influenzae strain 86-028NP
gtgagcgccttttgttttaggagaaagaaaatgaaagaatttaacttaaaagcagccttgaatggcgagcctgtgatgttgagaaatggaggaaaagccgttgttaaatacaatttgcttaacgaggttgaaaagctagaggtaagagataccgtatatccgttaatcgggtatagatttgatggtatttacattaatacgacatcatggaacttaacaggtaaatcagtacattgggcaaccatggaatatgacatcattggaatgtgggaagatcctaaactaacgtcagaacaagtgctggaaaaggcttgtaatgaggatttgctagtgctatgcgatggtaatcctgatttacctctaaaagttatcgccaaaactaaaaacggcgagtttgtgatgcagccggaagatggcatcatccaaccatggctcgctaatctgaccatggaatggttctttgtaaaaaaacttgatccaaaattcgacacaagcactttacctaagccgtttaaaccacatattggcgatgagtttttctatttaagcgatggagtgattagatatttttcgttttatgcagattgtgcagctaacttgatgataaatggtcaatgtttccgcacaaaagaagatgctcaaaaatggcttgattttatgaagagtatgatggagtaa

SEQ ID NO: 2091 - DNA, 1164 bp, H. influenzae strain 86-028NP
atgtttacctacggttcaatctgttcagggattgaagcggtaagcgtggcatggaaaggcttaagtaaaccgctgtggtttagcgaaattgagccttttccttgcgccgtgcttgcttatcattatcccaacatcccaaatcttggtgatatgaccaccttacccgaaaaaatcttaaaccgtgaaattcctgcgcctgatgtgcttgttggtggtactccttgtcaagcattttctgtcgctggtttgcgaaactcgttagatgacgagcgcggaaatctcacgttaactttaatacacatattagaggctattgattatgttagataccaagacggtaagcagccgtgcgttttgttgtgggaaaacgttccgggtgtactatccacaaaagacaacgcattcggacaccttttggctggattggttcaagagcgtgagccactgcaaccaacaggggctaaatggtcaaacgctggttatgtgcattcgtcccgaactatcgcgtggcgaatcctcgatgctcaatacttcggactcgcccaacgacgcaagcgcgtgttccttgtggcaagtgctagagaaagaagcgtcgcccaaatactttttgagcgcaaaagcttgcaagggtattctcaatcgtgcggaaaaacgcaacaaggttttacctgctacgctgagggaagctttggaacgtatcgccaatccgtattgggggggctagtaaaagctagtggtggggcgcttggtggtggctctgaaactattgtagtacatggtacgcaagacccgattatttccacatcaactgcccactgcctggggcgcaataatgggcaggaaaatgttttgttcgatatttcagatcgacgcgatgttgtgcgcatacaaaaggacggcactacgccaacacttaccgcaagaatggggacaggtgggaataacattccatgcatgagcatcaaccaaaacattcgcaaacttaccccttcagaatgcgaaaaattacaaggttttcctccaggttatacgcaaatatcgtatcgaaataaaccagccgaagattgcccggatagcccacgctataaagctatcggcaatagtatggctgtaccggttattaagtggatcggggaaagaatgattaattatttaaacaaataa

SEQ ID NO: 2092 - DNA, 897 bp, H. influenzae strain 86-028NP
atgtactggttcagaaatgcaattatttaccaattaacaaaacaaatagactttgagaatatcgaaaaacaactcaaagaatgtgaatttactccgtgtggttcagcagatgttagccatttcggttggtctgctccgctcgtcaccagcgaaaatttagcacatcaagcgaacggaaaaatcttacttgtagctaaacgagaagagaagattttgcctgtggaagttgtgaatcgtgaactcaataaacgaatcactgcacttgaagaaaaagaacagcgaaaattaaagaaagtagaacgatcatctttaaaagatgacgtgatagctactctacttccgcaagcattttctcgcatcaaaacgaccgcactttacatcgacacgttgaaacaacttatctttgttgatgcagcatcaagtaaaacagctgaggatgcactcgcacttttgcgcaaatcgctaggtagtttgctagtagtaccgttggcgtttaactgtgcgccgtgtgaagtaatgacaagatgggttacagatactgcacctgattggctaatcttgcgtaaggaagtggaaatccgcgaaaaagaagatcttggcgttattcactgcaagcaaaaagatgttgaagacgaggaaattattgagcttgttcaaaatggcttgatctctaaactcgcgcttgagtgggaaaacaaccttaaattcgtattaatcgaagatggcacgctgaaacgcctgaaatttgacgacaatatcaccgagcagaacgatgatattgtaaaagaagatgtaactgctcgttttgatgtagactttgtcttaatggcgagcgtgcttggtaaaacagtggatagcctaataaaagaatttggcgggattagggatagattatga

SEQ ID NO: 2093 - DNA, 1347 bp, H. influenzae strain 86-028NP
atggctgaagaaaacaaagaaattatagcttataaagggtttaagcaagactggacttgtcgaggttatcagtatgaggtaggcaaaacgtatgagcataaaggtaatgttaaggcttgtgagagtggattccacgcctgcgaatacccgcttgatgtgcttagctattacagtccagcggtaagtaaatttgctgtagttaaaatgagcggcgaaacatcaaaagatagtgatgatacaaaaattgcatctgcaaaaatcacgatcgaaaccgaaattaacttaccggaaatgataaaaaaagccgttgaatggataaaaggtaaagttgattgggatgcagccaaggtatccaatacaggcgattggtcggcagcaaccaatacaggcgattggtcggcagcaaccaatacaggcgatcagtcggcagcaaccaatacaggcaattggtcggcagcaaccaatacaggcgatcagtcggcagcgactaatacaggcgatcagtcggcagcgactaatacaggctatcggtcggtagcgactaatacaggctatcggtcggtagcgactaatacaggcgatcagtcggcagcgactaatacaggcggtcagtcggcagcgactaatacaggcgatcagtcggcagcgactaatacaggctatcggtcggtagcgactaatacaggcgatcagtcggcagcgactaatacaggctatcggtcggtagcgactaatacaggcgatcagtcggcagcgactaatacaggcggtcagtcggcagcgactaatacaggcgatcagtcggcagcgactaatacaggctatcggtcggtagcgactaatacaggcgatcagtcggcagcaaccaatacaggcaattggtcggcagcaaccaatacaggcgatcagtcggcagcgactaatacaggcgatcagtcggcagcgactaatacaggctatcggtcggtagcgactaatacaggcgatcggtcggcagcgactaatacaggctatcggtcggcagcgactaatacaggctatcggtcggtagcgactaatacaggcgatcggtcggcagcgactaatacaggctatcggtcggtagcgactaatacaggcgatcagtcggtagcggaaatatctggcaagcaatctatagctgttgcgcttggttggcaatctaaagctaaggcgagtattaatggtgctattgtttgtgtatatcgcaatcatgatggcgagctaatccatatcaaagcatcaaaagtcggtgaaaataacatcaaagctgatacttggtacacgttagatgaatttggtgagtttgttgaggttaaagatgactaa

SEQ ID NO: 2094 - DNA, 435 bp, H. influenzae strain 86-028NP
atggcacgtaataccaacaccgtgatattagtcggtcatttaggcagtgacccagaaatccgccaattccaaaatggtgggcaaattgccacatttaatctcgctatcggtgatgattaccgagataaacaaggtaatacagttaaacgtacgcattggatacctattgtggtgcatggcaattctgctgatgtagcaagacaatatctgcaaaaaggctcaaaaatctgtgtaacagggaaactggtacaggaaagctggcaagaccaaaacggcaataaccgcaccgcacttaaagtagcgacacaatcctttgaaatgctagacagcaaggcaaacaatgaaacacaacagccaagcaaagacaaagaaaaacccgacccattaagcgcagcggcagaacaagatgggtttgatgatgatattccgttttga

SEQ ID NO: 2095 - DNA, 645 bp, H. influenzae strain 86-028NP
atgtaccaactcaaagctaaatgctctggcttggctgatttaatggtaaagcctaaaagcggtaatggaatatctgctacagcaaaaagtgcggtgagaaagatagtgaaatttgatttattcggttatcgagattttgaggggaataaatacaccgagaaaggcattgcactagaagaacaagccattaagttaagcggtcgtaaacgtggattacctcttaaaaagaacacggaaagacgtgaaaacgattggattacaggcgagtgcgatatttatgtgccaagccgaaaattaatcatagatactaaatgttcttgggatattggctcacaccctttttttgctgatgaggcggaagaaaaagccaaaaaagcggggtatgacgcacaaatgcaaggctatatgtggctatgggattgtagtgaggcgcaaattgattttgtcctcctccccaccccttacgaccaattatcaagctatgatgacccaagtcgatacattgacttagttgagcaaatcccccaagaaaaacgtatcaccaccgtcacaattaaacgtgatgagaaagtcatcgagaaaatcaaagaacgagtagaaattgctcaagaatattatcaacaacttatacaggagatgcgctaa

SEQ ID NO: 2096 - DNA, 921 bp, H. influenzae strain 86-028NP
atgacaaaccaagtccaacatcaacaaaataaacagccacctgcacttaaaacattttttgaaagtgcgaatgtgcaaaataagattaaggaacttgttggcaaaaatgcggcaacctttgcaacaagtgttatgcaaattgccaatagcaatgcaatgcttaaaacagcagacccaatgagcatttttaacgccgcttgtatggcagcgacattgaatttgccactacaaaatggcttaggctttgcctacatcgtccctttcagaaacaacaaggaaaagaaaaccgaagcgcaattccaaattggctataaaggctttatccaactggcacagcgtagtgggcaatttaaacgcttagtcgcattgcctgtgtacaaaaagcaacttatcaaaaaagatttcatcaatggttttgagttcgactgggagcaagagcctgaacaaaacgaaaatccaatcggctattacgcctattttaaactggtaaacgatttttcggctgaactctatatgagtcacgatgacatcgtcaaacacgctcaacgctacagccaaacattcaaaaaaggctatggcgtatggcacgataacttcgaggcaatggcattaaaaactgtaactaagttattgctatcaaaacaagctccactctctgttgaaatgcaacaagccgtattagccgaccaagccgttgtgaaagatgtagaaaatcaagagttcaactacaccgacaatattcaagaagcggaatttttagcggttgttgatgaagccacattcgaacaatgcaaacaaagcattgctaacggcgaaaccaccctacaagagctttgtgatagtggggcttatgaatttagccaagagcagattgcggagttggaggcgattgagaatggaaatgtaccaactcaaagctaa

SEQ ID NO: 2097 - DNA, 294 bp, H. influenzae strain 86-028NP
atgaaaccttccgatgattactactatcaactcgatgctgcacaccaacgtaaagtggattggcaagcaggctatgaaatcgctttagatgaagtcgccacggaaatcgacaatgatttacaacaaggcgaccaaacgcattatcacgaactcacggaaatgttgtgtgataacgataatttctggcttgccattggtagcggtgcaagttatgagccttatagacaagaggcgattaagaaaatcgcagagcgtgaattgcacgacagaatgaatgattatgacccagattaa

SEQ ID NO: 2098 - DNA, 345 bp, H. influenzae strain 86-028NP
atgaaacactcgaaaaccccattacgccaagaaaaacaaagcttcacgcactttatgaaaggcagtgaaaaatggctaaacagaatctgctattttctcgccgccttgattattgccatgattgtgggtgggattagcctacacgccaatgcccaccccaccgattggcacgataacgaattaagccaacaaatccaacaagaaacccgatgtgaactgaaagggggcatatatgaaaacggtgtatgtttaccgcctaatcttacactggcagcagaaaaagaactgcaggcttacaccgcacaaaagcaagccgaaattaaccgcacttggagtaaacaatga

SEQ ID NO: 2099 - DNA, 738 bp, H. influenzae strain 86-028NP
atgaaaaccgaattattcaacgatcacttccaaaactacaaacgctaccacatcccaaaagcgcagctagtcatcgccgacattccctacaatctcggtaataatgcttacgcttcaaaccctgaatggtatgtaaacggcgataacaaaaacggcgaaagcgacaaagccaacagtagtttttttgatacagataaagatttccgcattgccgaatttatgcatttttgttcaaaaatgctcatcaaagaaccgaaagaacgcggcaaagccccttgtatgattgtgttctgcgctttccagcaaatctcaatggtgattgattacgccaagcagcacggctttaaaaatcacatccctttggtgtttattaaatcatcatcaccacaggtgctcaaagcgaatatgaaagtcgtcggcgcaacagaatatgccttgattttataccgcgataaactgccgaaatttaacaacaacggcaaaatgattaaaaactggttcgaatgggaaaaggacaaccgcaaggaaatccctaaactgcacccgacacaaaagcccattgccgtgttaaaacgcctcatcgaaatctttaccgatgagggcgatgtagtgattgatccagttgctggcagtgcatccacgctacgcgccgcacgagagcttaaccgcccgtcctatggctttgaaatcaaaaaagacagctgcaaaatcgcaaaagaaaaaatgcttaatatctaa

SEQ ID NO: 2100 - DNA, 1032 bp, H. influenzae strain 86-028NP
atgacctctaatgcggaacgatttaaattcaccgatgaacatattgcgtttattcgcttacattgggataaaaagccatctgatctaattaaattgtttcagcaacagtttgatttattaataaatcgtaatgttttctataaattaaaaaagaaacacaatattccaagccttaagcatgctaatcgttacagcaaagaagaacttgcgttcattaaagcgaattgcacgttaaatgaaagaatcttggctcaaaaaatggaagtttatttcaataaaccatttaatccacacgcgttaaaggttttgcgcgtgaagagacaatggctaaccggacgaagaggtcgatttgagaaaggtgaaaatttaaaaccgattggctttgagcgatattgtaaaaatgcaaaatgttggttaataaaagcaagcattaaacgttatgaacggaaatcgcattatctctggcgcaaagccggtagaaaaattccgcgtggacatattattgattacaaagacggcaattcaagaaattgcacccttgaaaatctcgaattaatttcacgtgttgaaatggcttggcgaaagaaattacagtatcaccaactcaatgatgaaattaaacccaccttttccgcctttgtaaaactcaaagaaggcataaatcaacgtaaaaaagagaaagatatggaagaaaatcaatcccccaatattgccacgcaggaaccgacaacatttacgtttgaatttaccgaacacgaattgcaaacaatggcgtgggcgtggtttgctttattgcgtggcacggaactttgccaagtgcttcaccccgcactaaaacaaattggttcgcactacgctgcttccgtttatgacatagcttacgaatatcgcagtactctccgtcacgcccataacgtattgacacgcattacagagcaatttgaatgcgagcaaggaaataactggcgcgtattaaaatatcttcgcgcctacgatcctaaaaaaacgggttttcaattagaaattctataa

SEQ ID NO: 2101 - DNA, 252 bp, H. influenzae strain 86-028NP
atgaaaaataaaatcacagacttaaacaatcatttattttcccagttagaaaaactgcttgatgaagacttaaccgatgaagaacttaatcgagaaattaaacgtgccaatgccgtatcaggcattgcggcaaatattatcgcaagcaatgcgatttcgcttaaagcaatgacattgtttgaaaatcgtcaaattgaaagagaatcccctgattttctaagaatatctaaggcgcaaggcgatgacctctaa

SEQ ID NO: 2102 - DNA, 312 bp, H. influenzae strain 86-028NP
atggcaactatcatcgtaaagcgtgatgcaggttcacgcaaattcaccgaaaaaggcgaaattttacaacgtggtaaagcgggcagattagaaagaatgttcgataaacaacgtcgcattaatgccgcgtttgaaaaaatggtggtaaaagaaagtgcggcggatcgcgcaattaaatttgcagccaaccgccaaaaagagcaatttatcgacatagccaactaccactgctgcaaaggtaaacctgctggtacaaacaccgtgcacgcagtgcagaagcgcagactaggggtaagagaattaatacgatag

SEQ ID NO: 2103 - DNA, 186 bp, H. influenzae strain 86-028NP
atgaacattaatagcccagcagaattaaaagcctttttcattaccgaagtgttagagcgttacgcagagaaaacaggaaaagccttagaagccttagcagatttgtttatgactaatgaagatttcagaaatctgattatggatgaagttgaagtagaggcaaaacaagttgtagcacatatttaa

SEQ ID NO: 2104 - DNA, 1149 bp, H. influenzae strain 86-028NP
atgactgatgccattttaaaagataaaatcctatctcacgcccaacacgtattacgtgctgggccacattgcacaaccgaagaaactaccaagcaagcattaattcttccattcttggatatattaggctttacatcatacgatccaactaaagtaaaagcggaatatactgcagattttgtcggcgcaaaaaatggtgaacgagtggattacgcgctattttgtcataacgtgccggtaatgtttattgaagcaaaatcctacaatgaagacttaagcaatcatgcaccacagctcgcgcgttattttaatgcaacccctgaagtagccgttgcagcaattaccaatggcaaagaatggcgatttttcactgacttgaaagataaaaatataatggatagtacaccatttttacgcataaactttagcagtcttgatgaaactaaaatcccacaactagcgcaattctgccacgataagtttcaaccagaagcactccgcacattagcggaagaaagtgtttatctttccgctttcactaaggttatttcatcgtctctaaaagatgtagatagcgattttgttcgatatattgccggtcgttccaatattggacgccagcttaaccagcgttttattgaatccattaccccaatcgtgaagcaggcagttgagaaagctgtgagcgaaatggttgtatcaggcttatccaagcagccggtaatggagcagttggaagagccagcatcggagatgattgatgaaaccgcgcctgtcgtcgatcctaacaatagtaaaatcgtgacaacctatactgagcgattattatctgaatatgtttcattaattctaggcgaagaagttgaactgatcgccaaagacactgaaagctatttcagcattttgtatcaaggaaaaacgaaccgctggatcttacgttattacgataacaagcaacgcccatcgattgtaattcctatagagctaaatgacgagaacagaaaggagatcgtgcgcgctggtttggaaatctcaggcagccaaattattatagattgccctgaaaacatcttaagattgagcggtatcattcgtgattgccttgagtattgtcaagatgatgaaaattttagagtgaagaaaaaataa

SEQ ID NO: 2105 - DNA, 861 bp, H. influenzae strain 86-028NP
atgatccccacctattgtgtaatatgccaaaaatctctcgctaacatcaaggaaactaaaatgaaaaaagctgtgctatcctcgctaatcttagttgcattacccttttcaacgcttgccgaagataaaatctacaatccaagtccacaagaaattgaattaatgaaattagtgatcaaggaagaaatagatgtctactttcaaggtgggaaaactgcttataaatatggtgattacgtatttaccaccatatctgaattagaaaaggaatatgataaaaatgaagctcgagccaacaaaaaattcaaaggcaaaaatttgatagtttcaggcacgataggtagcattgagacggatttattcgatcacccgtatattgtatttaaatcaaaaaatgaatttaacttcaacgcgacacaagcaaaatttaaaaaatctgcttacgataaagtgatcgatttaaataaaagcgataaagtaaatttagtttgtgaaggtgccggagaagtggcgggaacaccaatgctagacaattgccaattccgcgccgatgtcatcaaatccattacagatcaatatctcgcagattataataaccttttaacaaaaggcgtagatacatcaaaagtatttttaaataagatcgtatatatcgtcgcacgacgagcgtatataaccaatggatttagcaaatgcagtaaaaaaattacatctgattgccttgataagggcgtagataagaaaaaagaaaaagcaattgaagatgcggctgagaataatgattttatccctgaacttaaaccattagccgaatatttagatttccactacaccccaaaagatcagcgaaataatcaataa

SEQ ID NO: 2106 - DNA, 366 bp, H. influenzae strain 86-028NP
atgcagaccaaacacatcttagatattaaattaactgctcgccgttatggcaaatgggcgcgtgaaggcgtgggaattaactatcccgcaattcagccttttttacgcaaatccacgcccgatcacggcatcccgatgttggatgatgaaaccgcaatgcgcattcacgacgcaacacttattatgcgcaacgtcacaccagagttatatcaagtgtttatgctacggtatgttagcaatttatcgcaaggtgacgtagggcgggaaatgagagtgagtgtaccaacgataaaatcttatctttacgccgcgcatcaatctctaaaactacttctaacgcaaaataagtgtatttttctcgcttaa

SEQ ID NO: 2107 - DNA, 588 bp, H. influenzae strain 86-028NP
atggcgaaagaatataaatgcaaaatgtgcggaaactactttataaaaatcgtttctagcttgcaaaaggtctgttcgccggaatgtgccattaaactttcgcgcgaacagacccgcaaggcacgcgagaaaaaagacaaacaggcgcgaatcgaaaaccgcaaaaaaatgaccgcacttaaagagaaaaacaaaaccaagcacgaattgaccaaggaagcgcaagtggcagtaaataaatatatccgcctgcgcgatgtgggcaaggaatgtatctcctgcggcacgcccttagtggcagaacagctaggaggagggtttgatgctgggcattaccgctcacgtggagctgcgccacacttgcgcttttatactctcaatatccacggtcaatgtaaaaaatgcaaccgctactacggcggcaatgtacagcaatatcgcctaggcttgcttgatagactaggtagcgaaaaagtcgaacaaattgaagctgacaaccgcccacggcattatttccccgatgacttacggcgcatcaaacagatttttaacaaaaaatgccgattaatagaaaaaagaaagggataa

SEQ ID NO: 2108 - DNA, 186 bp, H. influenzae strain 86-028NP
atgcgatccagcgacttaatcaaggaacttaaaagtgcaggttgtacttttgtcaggcacggtaaaggcgatcatcaaatctggcaatcgcccatcacagggaagacgttccccgtaccgcatccaaaacaacacgtacccatcggcacattaagatccatcaaaaaatcggcagggcttctatag

SEQ ID NO: 2109 - DNA, 429 bp, H. influenzae strain 86-028NP
atgttattcactatcggcattgaaaccccaacaaacgaaaatgaagcctacggcattacggtgccagcattatttactgaagaatattcctgctttagtgccgctgatacccttgaggaaatcccaacgcaggtgactgatgccattcattccatcttagaaatgatgtttgaagacggaatagacatcaacgaacttcaagataaaggctatcgtcactaccaaacgcaagaagatttcaactattgcgatacttggttgttgcttgatgtagatatttccgcatatcaaggcaaacgccaccgtattaatatcagcttgcctgaataccttatcaaacgtattgatagccgtgttgcaagcaatccaatctacaaagaccgcagccactttttagcgattgcctcacaaaaagagctacggcaataa

SEQ ID NO: 2110 - DNA, 510 bp, H. influenzae strain 86-028NP
atggcttgtagtgttgatgatattaaaaaagcacacgggaaacgaactgaagggcggttaaaaattcagatgattaagttacaaggcggtgtgcttgcgccacttgatgaactggaatcagaagaattgaaatcattaaaaaatggcgagcagtatgaaattgaaatcatccgtacacgcaatcccgctttccatcgtaaggtgttcgccttttttaaattctgttttaaccattgggctgcagataaaacagaatgggaacactttgatgagcgcaagcaatttgacacctttcgtaaacatctaacggtattggcgggattttacgaatctacatacaacattaaaggggatttgcggattgaggcgcaatccttgagttatgggaatatggagcaagcagagtttgaaagctgttacaaagcgttaattagtgcagcaatcaagcatatttttaacgatacaaccgatgaaaatacgttaaatcagttgtatgcgttttttgggtaa

SEQ ID NO: 2111 - DNA, 591 bp, H. influenzae strain 86-028NP
atgacagaacaacaatttgataaaaatacatggcaaacaccgtgctatgtatttgaatggctatctcaacgtttcggctggttcgatcttgatggttgcgctacagccaacaacgccttgacatgtcactatatcggcgagcctaactcagataatgatgagcatcaatcaatcgcagatgactttctaatgccgattgagcaaatgttagatgtattgttggatgaagtcgcagaacgttgttcggctccgttaagaatctatgtgaatccaccttattccaacgttacaccatatctacaacgtgcgaaagaattatgtgatgctggttatttagtcgtgatgttactcaacaatgataaatctactcaatggtatcaaaaccatattcaaggcgtggcaaatgaagtgattgatattacaggtggtcgaattgcatttatcaaccctgtaacaggaaaagaaatcaaggggaatagcaaagggcaaatggtcgtagtctttgatccaacaatggaagactttgtcacacgttcaattagccttgattttattaaaaaggttagtgggtatatccgcatggagaaatag

SEQ ID NO: 2112 - DNA, 636 bp, H. influenzae strain 86-028NP
atggcaaattccataacacaaaaccaaattaacacgctcccaccagaacgagcacagcgtgcggaagagacgattaactggctctttaacgagcttaaatcaatttttcctggttggcgtgcagcctttgaaaccgaagcggattatctctctgctaaaaaaacttggttgcgtgtgttggtacgagaaaaaattacgagacctcagttggagaacgggatttgtgaagcggaaaaatcgcttgataaatttttacctagcgtagggttgttcgtttattggtgcaaagcctacgactatcacgcactaggtttaccgaacgaagcggaattataccaacgttataacactttcttaggctatgcccgattcaatcgggatgaatttcaatatcgttcaaaagtggaattttggttgcttaaaaatctgtacgaaaagtgcaagaaaaaatcggaagaggacacgttgaaagctattccgaaattactcacagaagcggcggaaaaagtgcggtcgaattttccttttgaggatattccgaagatgattccagcaaagccaagtttttacgataaagcgaaggctgataaggcgcgcgatagcttgatggcaatgatgaaaggggcattgcaatga

SEQ ID NO: 2113 - DNA, 783 bp, H. influenzae strain 86-028NP
atgagtgttgagttaatgactaaagcatttaaaagcaaaaccggcaatcctttaacaaaattagtgctggtaaaattagccgataatgcgaatgatgatggcgtttgttatccaagttataaacgtattgcaatccaatgtgaagtttcgcgccctacggcaatttcgcacgttaagaaattggaagcgatgaaatatttatccattcgtgaacgtaaaaccgaaaacggcaacgccactaatgtgtatatcttgcatcccgaaaactgggaaatattagagccttttactagtaaagcagctttaccacccctagtaaacgagcttaaccaccctagtaaagcagctttaccacccctagtaaacgagcttaaccctgaaccatcaatagaaccatcagataaccatcatattaaaaaaactacgcaaaaaagcgaatccgaaatgttgcttgagcagttcggtattaccggacaactggcgaaagattttatcgcacaccgcaaagccaaaaagggcgtaattaaccaaacgcaactcaaccgcctgcaaaaacaagcggacaaggcggggatttcgatttgtgaagcggtggagatttgcattgaacgcaactggcagggatttaacgcatcatgggattggcgtgatgaaaaactgcgaccaaatttaccgcacttagggcaatcacaccccaacaaacccaaatttgacgatacgcagacaggctggtctgcaggaatgaatttcacagtggacggtacgcaatggcaaattccataa

SEQ ID NO: 2114 - DNA, 234 bp, H. influenzae strain 86-028NP
atggagaatactaatccaaacgaaaaaataagtcaatcgcaatgtgaccgtattttgcgttatttgcaatcaggtaagcgactgacatcactcgaagctttagacaaattcggttgcttgcgtctttcggcgcgaattttagatttaaaaaaccgctggcatcagatttcggacgagttcgtccacgatgcacgcacaggcaaagtatataaagcgtattttatggcggtatga

SEQ ID NO: 2115 - DNA, 453 bp, H. influenzae strain 86-028NP
atgaacagtaaagacattcagcgcacgttacatcgcgattgtaaaaacgcatctggcggtatcactacgctggcactcacgctaggcaaatcgccgaatattttaggcaataaacttaacgtagaatgcgaaaacaatcatctcagctttatcgaagccctcgatctcatcgaaatcaccaatagcacgcgcaccgtcgccgccattgccgacaaaatcgatcatcttatcgtacctatgcccaaatgcgccagttgctgcgccgatgtcgtgcaaggctttttagacattaccaccaatgcagggaaaattggcgaacaaatcaaaagcgcagtccatcctaattcagatttagggcgcgagttatccaacaaagaaaaacaaacgatttccgccagcattgacgcgctcattgaaagcgcattgtgcttaaagtgggaattagagcaataa

SEQ ID NO: 2116 - DNA, 207 bp, H. influenzae strain 86-028NP
ttgatcaataaaacaattaaaattgcgattgatgaatgtggtggtcaagccaaattagcaaagctgtgcagtgtcgcacagcctacggtttttgcttggcttcaccgtggtggtattagtggcaaatacatcccgcttatcgccaaagcatccaatggaaaagtcaccgaaaccgacatcttgcgctcactcacaaagtcacaatag

SEQ ID NO: 2117 - DNA, 969 bp, H. influenzae strain 86-028NP
atgacaacattgggcgagcgattgaaatttttgctgattgaaaggaatgttacacaagcagaattggcggaaatggtgggaactacccaaggtgcgatcagtaatatcgtgaaaggtgaaactcaaaaaccaagaaatattcttgagattgccaatgcgttaggtgtagatccaaactggttaaaatatgggagtacaaaaatgacaaaattatcagagagattaaaagcgttgctggtagaaaaaggaataaaccaaaccgaatttgctaatatgatcggcattgctcaaccctctatgcagaaaatccttgccggagaaaccagaaatccacgcaaaattgttgaaatagcaaaagagctcggtacaacgccggattatttgttgtatggcgatatgaccgttagtcattccactttggaaaattctcagatcaataacaatcaggggcagaccgtcaataatttttttgacagtggaagtgatgaattacgcgagatgttgcataagcagcagatttcattaaaaacgaagccaacggaagaatgggtttttgccttagatgtaaatcgtttagctgagacagatataattaatgtgcatttccctcgcccttttgaagctttgcacctttcgcaagatgggatgatggatttattgaaattacgctctacggcgaacgtggcgatgataacgatgtttaatgagagtatgtcgccggtaattaataaaaaagatttgatgtttgtggatacgacttgtaaacaatatgctggcgaagggatttatttgtttgtaatgaataatgagttgtatgtgcgtcgtttatatcaaacaccgagcggtgtattaaatgcggtggcggagaatgagcgcgtgggatcgagctttgaaattgatgatttgtcacgtttaaacgtactgggtcgttgcgtgcgaaaattttctattgttgcagaggatttataa

SEQ ID NO: 2118 - DNA, 327 bp, H. influenzae strain 86-028NP
atgccgactaaagatccgactaacttggaatcttttttacgctggctcccattggtttttatcggattatttgccggcgttgcaaaatacgcaagcgatattcaagcgggaaagctccactttagcgtggggctttttttatgccaagtgcttgtgtctatgtttgcggggtggattgggggattgatttgtctttcttccggtcttgatagcgatttagtttatgtaggctcagggctttctggttatggtggtggcgcggtgcttaatgccatttggcgggggttctttgcgtctaaattggggattaaagatgagcaaatttaa

SEQ ID NO: 2119 - DNA, 405 bp, H. influenzae strain 86-028NP
atgagcaaatttaagctatctgctgctagtgaagaaaaactagtaggcgttcacgcggatttagtgaaagtggtgcaccgtgcaattgaattaagtgtggtggattttaaagttattgagggtaaacgcacgttagagcgacaaaaagaattgtttgccaagaaagcgacaaagacaatgaatagtcgccatttaactggtcatgcggtggatttagtgccgttaccagtgaattggaatgatcgcgagccatttaagaatgttgccagtgctatgtttcaagctgctaaacaattgggcgttgctattcgctggggcggtgattggaatatgaatgagagttctaatgatgagcgtttttatgatggaccgcattttgagttattacggagtgtatatccatga

SEQ ID NO: 2120 - DNA, 390 bp, H. influenzae strain 86-028NP
atgacgtggtggctatttgttataaaaaaacttgggcttaacgtgtttagtcatggttgcaagcatttcaataaagttgtcgctgtatttgcaggagtgtttattcttgcgttgctttatatgcagcacacaaataagctcaatattgaacgccaatcagctgttattgattctctgcatgaaaaagtcattaagcgggataagattattgatgaattacacgaagatgtggacgagcaaagaaagattgccgaaaagcggttagcgcaagagcagttaatcagggagcaaagttatgcgcaaattcaatccattaagaaaatactggaaagtaatcagtgcagccgtactgtactgcctaacggtgttgctgacgagttgcgcaagtaa

SEQ ID NO: 2121 - DNA, 231 bp, H. influenzae strain 86-028NP
gtgttgctgacgagttgcgcaagtaagccagaaattgaataccgcacgcttgccttttcgccgccggtgagtttgcttgccccctgccctattccatcattccacggttcaacctttggggagacggtggaatatgcgttattgctcaagcaagaattgcggttatgtgcgaataaggtggacggggtgcgggagtatgtgaaggcgcgggaaagtgcggcggaaaattag

SEQ ID NO: 2122 - DNA, 960 bp, H. influenzae strain 86-028NP
atgatgaataaagatttaaatattgaatatatttctacggatgttctaaagccttatgtcaataatagtcgcactcattctgatgaacaaatcgatcagatttgtgaaagcattgaagagttcggttttacaaatccaattttgattggcgagaataatggaattatagcgggtcacggtagattattagccgcaataaaactgaacttatatactgtgccgacgattagattaacgggcttatccgatattcagaaaaaagcctacgtgattgctgataactcactggcgttgaatgccggctggaattttgagctattaagtttagaattaaatgaattaaaagatctcggttttgatattgatttgcttggctttgatgatgattttttaaaaagtttagatggtgatttattggctgatataagcggtgattccaattctaaggaaaaacttgatcttaaacaggcgtttttagccccccctttctcaattttaaattctagagaaggttggtggcaggatagaaaaagaaaatggaaagccttgggtattgatagcggttcaggtcgcgatagcggtatgcagcgcggtatgaacagtatggcaaggtataactcgaaagaagatacttcaatgtctgaaagcgatgattcaatatttgatcctgtgctttgtgaaatactgtattcttggtttagccctaaaggctgtcaaattttagatccgtttgcaggtggtagtgttcgcggtattgtggctagtaaattaaatagaaattatatcggtgttgatcttagagccgagcaaattgaagctaatttgaagcaacgaaacttggtttgttctaatgatgagttgcagcctatatggatttgtggcgatagcataaatattgataaattagctaatggtgtctccgccgatttagtctttagttgcccccttatgccgatctag

SEQ ID NO: 2123 - DNA, 420 bp, H. influenzae strain 86-028NP
ttgcccccttatgccgatctagaagtttattctaataaccctaatgatttatctaatatggattatgataattttaaaaaagcgtattttgaaattatcaaaaaatcttgtgatatgttgaaagataatcgctttgcttgttttgttgtcggtgaagttagggataaaaaagggaattactataatttcgtaggagatactattcaggctttcttagaagccggtttaagctactataatgaaatgattttagttaatgtatgtgggactatgcctatgcgtgcggctacgccttttaaaggtagccgcaagataggaaaggtgcatcagaatgtcttggtctttgtgaaaggaaatcctaaaattgctgctgaatattgtggagatgtagacgtgtacatcccgaatgaagacaattaa

SEQ ID NO: 2124 - DNA, 222 bp, H. influenzae strain 86-028NP
atgatgaagaaaattgatgtattaaaagatttgatggctaaaaatgaatggaaaaaagcaatctcactagcaagtaaatttcctagattgggaaatgctaaagatgcaattaaatcagcgcaaatggcttacacaaaccctaattttgtccgccagataaaaaaagaccccgataagttaatttatcagggcatccaagcattgattgccaaatacggttaa

SEQ ID NO: 2125 - DNA, 369 bp, H. influenzae strain 86-028NP
atgagtaagaaaaaaacaaaacctaagattgagatagatttatcaatggttgaaagtcttgccgctcaggggcttactaatcaacaaattgcagatagcttaggtatttcagagagaacgcttcaaaatcgtaaaaaagataatgcagaatttgccgaagctataaaaaaaggcaaggctaaaggaattgcggtggttacgaatgctttaatgaagaaaattaaatcggggaacgttaccgcgatgatattctttctgaaaacacaaggtggttggaaagagaacaatcagcttgaaattgagatgaagaaagagaaaaaattgcctaccctggcggagttgtttggcgatgagacagaccctgattaa

SEQ ID NO: 2126 - DNA, 1317 bp, H. influenzae strain 86-028NP
atgattaagtcttgccgttataagattttgtatggtgggcgtgggagtggtaaatcgtggggcgtggcgcagttattgattgagattgctgttcgtaccaaagtgcgggtgttttgcgggcgagaattgcagaactcgatgagcgatagtgtgattaaacttattgcggatacgatagaagatcttggctatctagaagagtttgaagtacagcgcaatgcgatttactgcttgaaaaccggctcggagtttatgttttatggcataaagaacaatccgaacaaaattaaatcgcttgaggggattgatttggtatggattgaagaagccgaaaacgtctctaatgagagttgggatattttaattccgactattcgtaaagagcgatctgaaatttgggtgacatttaacccgaaaaatattcttgatccgacctatcagcggtttgttattgcgccgcctaaaaattcgttcgttcgcaaaatcaactacgatgaaaacccttatttccctgaaacgttacgccttgaaatggaagaatgcaaagagcgtgactatgaactgtatcggcatatttggctaggtgagccagttgctgatagtgacaaggttatcattaagccggtatggattgaatgtgcagttgatgcgcataagaaattgggctttttgcctgccggtcgcaagattgtgggctttgatgttgcagatgacggcgtggatagtaacgccaatgcgtttgttcacggatccgtggtgttgcgtgttgatgaatggcgcggggaagatgtgattggtagtgcagacagaactcggcttaatgcattggaatttggcgcaaatgaaattgtttacgatagcatcggcgtgggtgccggtgtaaaagcacactatcatcgcctagacgataaatccattcgtattaatggctttaatgctgggggcgcggtatttgaacctgatgcagaatatgtttatggtaaaaccaatcgcgatatgttcgccaatattaaggctcaggcgtggtggcgtttacgcgatcgtttctataaaacctatcgggcgataacgtatgaagagcaatatcccgttgatgagatgattagtctttcttccgatataagggatttggaatatttaaaagcagaattggctcgcccttatgtggattatgacggtaatgggcgtgtaaaagtagaaagtaagaaagatatgaaaaagcgtggcattccgtcaccgaataaggcggatgcgttggtaatgtgtttcgcaccgaaagaagatgtattgtcgcgtttcattgggttaggaagttaa

SEQ ID NO: 2127 - DNA, 1317 bp, H. influenzae strain 86-028NP
atggcatttaatcaagacggctacgccgaagccttggggattaatcattttgcaagaaattctgcaaattcaaccgcactttttgatttaacgttatatgagttaggtggtttagccgcacgggtggtcgatatgccagcagatgcggcgatttcacgttcgattgaaattcaaggcgatcaagatgatgcgattagcaatgagattgaacggttgaagattttgcctgcattggcagatatggtgcgttggtcgcggttttttggtggtgcggttatggttttattgaccgatgacggtgcgcgattaagtgagccgttagagccaagtcgcattacacgtatcgatgaagtgcgagtgtttgatttaagtcaaatttcgcctacggctaatcgctattccgatccaaccaagccaaattatggtcgctattccagttatcggttaaatatcggtacgattgctggttcgcttgatagtcaggtagaaatccatgaaagccgtttgttatttatgggcggcgattcattgccagaacgtctaaaaaatggcttacattggattgggcgtagtgcggttagatcggtttatccaaaaattcgtgattatcaaaaatcattgatgtgggcttcgttaattcttgaacgcaaacagcaagcggttcataaaatgaaagggcttgcgttggcaattgataatggattagagcctgttattcgagagcgtatcaatcttgttgaacgtgggcgtagtctgttaaatggcgtagctgttgatagcgaagacgattacaacattctcaatgcggatttaggcgggattgttgatgtgcttgatgaatttaaagtagcgatttcggctgatgtgaatattccagtggcgattttattcgggcagtcagctaaaggtatgaacgccacaggacagagcgattttgaaagctattacgatttggtcgaaagtattcagcaacataaaatcaagccagtgcttgaaaagctgattgagctattgatgtttcaaaagcatattaagccgtttgagaactggaaaatcaaattcccgtcgcttaatacaccaactgacaaagaaatagccgatgtgcgtaaaacgaatgcggatgcagcgaaaatcgagcttgatcgcttaattaatttggttgattcgggtgcgttatccacagaagaattgcgagtacagattgctggagagtttggcattcaagcggacaaattgccacaggtagatgacgatgatgttgaaaagtatcaagaagaacagaaagccaaaggtgtggttgtttcctcacgcaattga

SEQ ID NO: 2128 - DNA, 813 bp, H. influenzae strain 86-028NP
atgacgatgatgttgaaaagtatcaagaagaacagaaagccaaaggtgtggttgtttcctcacgcaattgagcgtgaatatgtgggttatttacgtggtgtggcgagaaacattaatacgatggttaatcaaaaactcgttgaaattcgaccgcactttcaggcaaatattcgacaagatagtttttctgatacgcttgaacgttggcttattgaattattgcaagcagtattgatttttgttgatgaaaaagaaattacgcagtttgtgcgtggctatattcatcagacggcgaattttaacggcaagcagtttcataaagtgctgaaatcagtttatagcgtcgatgttttcacgactgaaccttggcttgatgatgcgttaaaaattgcggaatgggaaaatatccgcctaataaaaagccttcctacgcagacgttagaaaaattgcgtagtcgctttactcaagcggtgcgcggtggttggcgttgggaaagcgtggtagatgatgtgaagtctatccttaacaccaacgagaaacgtgcaacattaattgctcgtgaccaaattggcaagttaaacggtcatttgacgaagttgcgccagcaaaatatcggcgtgaagtcgtatatttggcgcggtatgcttgatgagcgtgagcgggcgccccacgttgatcgtgagggtaaacaatttgattgggataatccacctgatgacggacatccgggggagcctattttatgtcgttgctatgcggaggcggtattccctgaatttgaagatctaaacggtgtgatttatgcggagtaa

SEQ ID NO: 2129 - DNA, 1074 bp, H. influenzae strain 86-028NP
atggtaatgcgatacgaccgccgtggcattcaggcacggcgagatgataacggttttatttatgacacccctattctgacaagaagtggggtgtttgtttatgagcttcctaatggcaaaactcggcgtgaatatcgtccgcctgatgaagtatttaaggcggatagtttacgcgcttacaagggattgccgattacagaagatcatcacggacttgtgacgaaaaataatgcgcatttggtggtgggctctatcttaacggaaggtaaacaagatgggcaaaatttaacggcagatattgtgatccacaatacgaaagccgttgattttggaaaaaaagaattgtcggttggctataaggtagatattgacgagacgagcggtataacagaagacggcgagccgtatgatgtgatccagcgtaatattcgtcctaaccatttagccattgtgacagttgggcgtgcaggcaatgccgcacttaatttagatgcggcagatgccgtggaatttaacgaagatggagaaaatccgatgagtaacactcaaacaacgctttctgacattcgcttagatagcggcattacgtatcaagccgcgcccgaagtgattgtggaattaaataaactcaaacaagacgccaaagatgctgtgacggcgaaagacaaagaagcggcgcgcgcagatgcggcagaagcgaaagtgaaagatcttgaagcacaggttgaacaaattaaacaagatgcggtaagtcaagccaaggtgcgtgttgaattagaaaacgtagcgaaagcgcataaggtggaagtgaaagctgatagtaccgaccgtgcgttgcgtgaagcggtaattaaggcaattcgtcaagacaatgcggatttatcgcaaaaatccgatggttatattgaagcagcgtttgatattgcggtaagcgatgccaaacaacgagcggatgcggcaggtgtgcagcgtcagcaattaacaccatcagccacaaatcaacccacattcacgcaggatagccaaacgaaattaactggtcgagctgcgatgattgcaagtcgtaaccaatag

SEQ ID NO: 2130 - DNA, 420 bp, H. influenzae strain 86-028NP
atgtctatgtacgatcaattacaacaaaaagcctttgctggtatgaaaggcgacagccgttacgatttagtcgaaacctttgcagcagaaaatgaaatcccattcggcgtagtgattacgcaagggacgagtgccacacaagctaaattaggtggcactaagcccattggcattgcgttacattcccatgctgtagtaggcggttatgcgaaatttgatgcggtttccgtattgcgtaaaggggttgcgtggtgtgtagtgaaagacagtgaagcgattacggcaggaagtgcggtaagttttgaccccgcttcaggcaaggtggcaaaaactggtacggcattaccgaatgcaacctttaaaaccgccgtagtggattgcggtaaatatggcaagctcgcattagtcgagttagcttaa

SEQ ID NO: 2131 - DNA, 1002 bp, H. influenzae strain 86-028NP
atgtttaacgatgccctaagtgaaaacttggggcttttttattggagaaaaataatgacagatattcgtcaagatgcatttgagttgaatgcgattaagacttgtttaaatgcggtgggtgtatttaaccaagatgcgggcttgtttacgcaacgccaattagagtttgtgcgcaacaaaatctatgaagaaaaattaccgggtatgaatggcttatcgctcgtcccagtctcttctgaatcccctgaatgggcagaaaccgtgactgaacgcatttacgatatggtcggcatggctaaagtcgttgccaactatgccgatgatttaccgcgtgcggatgtggcgatgacagaacgtgcagtaaaagtgaaaaacatcggtgctgcttatggctacaatctacaagagttgaaagcggcgtcagctaatcaaacggatttaccgtcttctaaagctcgtgcagcgcgtcgtgcggtggaagtaaagatgaacgaaattgccttgttaggagataaagaatttggtttaaacggctttattaaccacccgaatttaggagaaacctcggtaactggtggctggaaaactgcaacggcggatgcggtgctagcggatttggacaatctacacgataccgtcgtgttgcaatcaaaaggcgtgcatcagccaacacacttattgttgtcgctaacagattatcagacgttatccagtaagtatatgaacacggctgacaaagtggacgtattgacgttcttcaagcgtaaacatcctaacttaactattcagggcttatgggaattagagaaagcgggtacagggaataaaaacttagcgatttgctatgaaaaatcccttgataacttaactcttgaaactccgcaagattttacccagttaccggcacaagaacgcaatttagagcttgttgtgaactgtgtggctcgtgtgggcggcgtgttcttacgttatccgttatcggcaaccaaagcggagatttag

SEQ ID NO: 2132 - DNA, 189 bp, H. influenzae strain 86-028NP
atgattgtacgtaatattgaagcgcgtttaattcgtgttggcggcgagtttatcgcccctaatcaagaggtggaaattgccgatgatgcggtagggcttgatcgtttaattgaacgtggcgtattaattgacgtaacgccgaaagcggaagatgcgaaaaaagacggcaaaagtaaaaagcaggagtaa

SEQ ID NO: 2133 - DNA, 351 bp, H. influenzae strain 86-028NP
atgagcgcatactcgttacttaatctcttttacccattaagccaacaaatgcctgaagatatggtaaataaggtgttaagcgtggctgataataaacgtccagactgtttatctgatgaaaagcaagatgaggcggtggcgtggtatgcggcttatttgttggctcagtcgattgaaagcggggtaaatgcggcaggtttacgacgtgaacgtgagggcgatttagaacgtgaatatttttcaagcagcgataaaggcggcaacgctgaacgctttttggcgaagtataacgagctaaacaatatttgcgtgcgccttggtgcgattaccgtagggagtcattgtgtctag

SEQ ID NO: 2134 - DNA, 459 bp, H. influenzae strain 86-028NP
gtgtctagcgtggttaaggtaaaaatcaacaataaagggcttgaaaaagaacttgagttgataaacaaaatcggcaaagcacgcgtaaaagtaggcgttcaagcggatgcaggcattcattctgaatcaggcgaaagcttggtggatatcggtatttggaatgaatatggcacggcacatatcccgtctcgtccttttattcgtcaaacctttgaagacaaccaacaggcattggcgcaatacttagggcgtgtggtcgagaatgtggcgaaaggggatgatttggtgcaagagctttcaaaacttgggcaatggtatcaagacaagcagaaaaagaccctaacgtcttatccttggacaccgaatgcaccatctacgcgtaggcgcaagaaaagtagtaaaccgctcgtagatacctcgcaattagtcaattcaattcgttataaggttgaaatctga

SEQ ID NO: 2135 - DNA, 360 bp, H. influenzae strain 86-028NP
atgcagatattttcttctcaatcttcttttcgcaagccttataaaatacttgtgcgttctgacggagagtatgtgaaaggcaagtgggtaaacgacggcgaaatcgagcagacgttaatggcatccattcagccgttaagcagtgctgaaatggatcgcctagtggtatcaatgcaggggcggcgcgtttcaagtgcggtaaaaatttacaccgatcaaaaactaacggtggctggagaaaatgcacacaatgtcgcagtagtgctatttgacggcgagcgatacgaagtgatttcacgagctagttatcacagtggtgtgttgtcacatcatcgctacgtggctatacgggtaaaataa

SEQ ID NO: 2136 - DNA, 510 bp, H. influenzae strain 86-028NP
atgcttgagcgtttgtatgatttattgggcgatctatcggatcgcccttttattcgcgcctatgaaaatgggcgtgagccagaaaagccattttttacttatgaactgaagtttgagaggacaccagaacattttcattattcggcggtaaatgatgaaggcaatcagacggtaaaaactcatatcgatgccgtgcttgagttgaattatttcggtggaaacagtttacaggcattgcgagatgtttgtatgcgcttatctatgcagtcttgtcgtgagcgttggttaaatgatggcgtggcattgattcgcattgggcggattacccatttagcctttctaaatgaacagcgtgaatatgaagatcgggcaatggtagagcttgaaattcgttatgcggctagtgtgcaggatattgtgggtattattgaacaagtggaagtgacggcaaatataggacgtgcttctgagaaaaatttaataggggtaaataaaaatggcgaaaattga

SEQ ID NO: 2137 - DNA, 1074 bp, H. influenzae strain 86-028NP; identical to SEQ ID NO: 714

SEQ ID NO: 2138 - DNA, 426 bp, H. influenzae strain 86-028NP
atggctttagcaacttatgcgcccgatgaagtaagcattgtgatcggggcgagtattgtttctggctttgcagatggaacctttattgatattgaagaaatgtctgacggcgtatcatctgttgctggtgcagatggcgaagtagcacgtgcaaccagtgccgatccacgtaaaaaagtcacattaacgttattacaaaccagtgataccaatgatgtgttaagtgaactctatgcagcggataaagtgagtaaaaacgcaacctttccaattgcggtaaaagacttgcgtggtcgctcattattcgctgcaagcacggcgtgggtggttaaatcggcgaaacttgagcttggaaaagaagtgggttctcgcgagtggacgcttgaaactgcggacggtaaattatttgtagggggaaatgactga

SEQ ID NO: 2139 - DNA, 483 bp, H. influenzae strain 86-028NP
atggcacgcagtgaaattcaaattggcgaaagcactttttttgtgcaaaagttttcggtaatggatcagttacgcatttttggcgatttgcagaaaacccttgtaccgtcactggcgaaagtaatcggatttagcgatgaaaaaccgaaagatgcaacgtcagctcagttagccgaattagcacagaaaagtgcggcgaattttgcgcaaggtttacaagatttaagccagcaattaagcggccaagagttagttaaactagctgatatgctaatcaaacctgaactagtgacggtgcagcgtgatgatttcaacaatgggacagataaaaaacttagcaaaactgattttgatttggtgtttgatgatatgtcggagcttatcgagttggtaattttcatcttacaacttaatttcagcagtttttttacgaaatttcttgcccgtcttgggtcggtgcaagagcttgtgaagaaagcgtaa

SEQ ID NO: 2140 - DNA, 153 bp, H. influenzae strain 86-028NP
atgatcgcttggcgtccttttttagccggtaaagttacactaacagagcttaatacggcaggattgacggatatgggcgagcttttgaagattaatcgcttactagatgcggtagatgcgatggaagcaaaacaaatggagaaaaaccgatga

SEQ ID NO: 2141 - DNA, 2418 bp, H. influenzae strain 86-028NP
atgaatgctatacgtgagctggtaacgttattgcgttataaagtcgataattccggtttaaaggcttatgttgttcaaactcaacaggcggcaaaaggcattcgtagcaacctgaataatgcagtcgatggattacgcgctaaattctcagaggctgccgtgagcgcgaaaggcgtcggtaataatctgaaagacgctaaaaatcaaatactttctctacgtaactttgttgctggttattttgcgatgattgcaggcggcaatgtgattaagattgcggacgattgggctgcggtggatagtcgtgtgaaattagcgacaaaatccgctgaagaacataaatatgcattgagtcagattttcgatctttcgcaacgttccggacaagactatctcgccagtgcggatttattctcaaaagtgaatcgaagtgcgggtgatttggggttaagtcttgatgatacgttaaatttaacggaaatcattgggcaaacgatgactattggcggcggcgatcagggggcgcagcaagccgccttgatgcagcttggtcaagccttaggctcgggtgcattacgtggcgatgagctgaactcaattattgaacaagccccacgtttagcgaatgccattgctgatagttttggcgtgccgattgggcaattaaaagatctaggtaaagaaggtaagctcacatcaaaagaactcgcacaaggtctgctaaaacaagcggataaaatccaaaaagaatttgatcagatgccgaaaacttttgggcgcggtatgacgattctgaaaaataaagccggtcaattgattgatgtggcggtcaataaagtctctaaactcggcgcggctttctataatgctgctgaatgggtgacagaaaacattcgtttagtgggctttttagctggtacggtaatcggtggtaagctgatgtttgcgctggcagcgtcgaaaaagagcttgcgtcaattgttaatgatgggcgcacgtgcggtggcaccttacttagcgatggctgcggcggcgggtgtcgttgccttagtgttagaagacatttatggttggacgcagggagatttatcctttactggggcattagtcggacgctatgaagtttgggcggataaattcgccgcgctaggtaaactggcggataagctctggatcaatgttcgtggtttattaaaagatttaagccggatggcgggcgttgagattaattttgactcttggcaggcttttgcaactgatgttttagaatatattattgccgccgtgaggaatctcattaatacggtaagcggtatggtgcggattattcgcgcattaattaatggggattatgccggtgcttggtctagtgcgggcgatatgattgatggattaagcttgaaattcctaccgctttattctgttgggctaatggtgctgggcggtattctctccgctgtatgggcgttattttccccattccgtgcatttttcggattgttgaaaggtggatttagatccgtaatgtttgtagccaaaccttttattaaggtagcgaaagggattgcatctccatttatctgggcgcaaaaacattttaaattattttcccgtgtcggcagtggcgcattctcgctgttgaaacgtggggcggtcaaatttacggtttatgggttgaaagcctttaaatggctcgctataaaaggtatcaatgggttctttggtattttgcgtgcggcggtcaaatttggcgtgatatttaaatctgtcgtcggcaccgtggtaaaaggcatttttgcgatcggtcgtgcgatgtttatggcggtagcaagtaacccaattttgcttgcgattagtgcggtgattggcttggttatcttgcttgttgtgtattgggatgaagtgaaagcctttgccattgctgcgtgggaagccatttccacaaaagcggcggagatttggcaaagtatcatcactggtgcaagcgagatgtgggataacatcacaaataaagcagcggaaagctgggataatgtaaagaaagatgctggcgaaaaatggaatagcgttacgacgatgtttaaaaatgcgtggcaaaaatctatcgataccgtggtgggctggtttaattcacttattccgagctggattagagatttgttttctgacggggcgaaagcagaagttaagctgagcggcgaagccttaactacaccagtaagcggccacgtatcgccacagcggttaggctatggcggtcgtcctatttttgcacctaatcagaatatgacgcaaaccaataacttcaatattcaaggttccgctaatcctagcggtgtggctaatgcggtatcagacaaattaagccgtggttcatctacatcgtttggaatgggggcgattgaatatgctgggtaa

SEQ ID NO: 2142 - DNA, 573 bp, H. influenzae strain 86-028NP
atgtcaaacttaaccattctcaacaattctattcgttcatacgaaaatcttttctctttaaacgatttacacgttgctagcggtcgaaaagagaaacaccgcccaaatcaatttatccgcttagaaaccactcaagaattaattaaagaaattcaagacgaagatctaaatgcgcagatctgcgcatttaaaactattcgcggcactcaaggcggcacttacgcttgcgaagaacttgttttagcctacgcaatgtggattagcccaaaattccatttgatcgtattacgtgcgttcttagcaatgcaccgtaacgagccaaaacaacttacactaccgcttgtcagtgatgaacttaaacaggcaatggcaaaaatggtaacttacgcatcacaatatgccaacttccagcaagccattacaggcgcacaactggaagatcaaaaacgccttgtggagttctttttttccagcattccaaatggagatagctatctgtttgtgttcaacaaaaacattcagcaagatatacaacaggcaagcgatttactgcataagctaatcacacaataa

SEQ ID NO: 2143 - DNA, 582 bp, H. influenzae strain 86-028NP
atgagcatagtaaaccttttattttcagcccttgcgggcaagcgtacgacaattggtgtattggaattggacgcacttttaaccgaaaacacatcactttctagccaaatcacggaatatcccattgaagacggtacggtaatttccgatcacattacacgggaaagtgagcggttaagccttagtggtgtgattactggcacaggaacattgtttaatgttggcttagggaaatataaattgattgcagcaaaagagacgttgcgagaattacacgctaagcgtgaattagtgacgattgttaccggtcttgatgtgtatgaagattttgctattgaaagccttgagattgagcgcaacagtgatgacggcgagcggttaaatattagtgcggaatttcgaaaaattcaaaaagtgacgttacgcaaggaagaggtgccaccagagaaagccgcgccaaacgcaaaaggcaaagcgggacagacgaaagtaaaaaccggcaaagcacaaactggcaagccgacaaatacgcaggcacaaaaaatcacgaagtttggcgaatggactggtaaaaaagaatga

SEQ ID NO: 2144 - DNA, 315 bp, H. influenzae strain 86-028NP
atgatcacaataaaccttgcaaataaaaacgattttattaccgaagtaaatcttgatgatgaagtcttttttttacacttttcttggaacgacacaatcggattttggtcgctcactattgaaaatgcttataacgatgaactggtctcaagcattgtgattttgccgaatcgtcctttaattgcaccagtgcgtcgtgatgaattaccacttggagaattgattgcggtgcgtgatgataatttacaaacgattgggcgtgatgattttatcaatggcaaggcggtgttgatttatatcggagtggatgaatga

SEQ ID NO: 2145 - DNA, 957 bp, H. influenzae strain 86-028NP
atgagttatcgctttttacgtagttataaattgatgattggcaagaaagggcaaaaagatgccattgtgattgagccgccaatgcgtattgagttcgatattgaaaaagattgtgaagccgagccgaacgaaaataccattaaaatctataaccttgcatccactacacgaaaaactattgagcagccggatatgcggtgcgtgctgtatgccggttatgcgcaggaaggtgacgtgttgttatgctctggcgatattgccacggcatattcgtatcacgaaggcgcagattgggtaacggagctttatgttttagatggcttggtagaaattcgcgatacggcggtttcattaggttatgtcggtggcgtgagttctacgcaaattactaatgatattgctgcaaaaatgggcgtaaccgtagttggtgcagataatttgaaatcacgcacttgggcaaatggttttagtttttacggtgccgcacgtaaagcgttagacaaagtcgttgcaggaacggggcttgagtggtcgatccaaaatggcgaactgcagattgtaaaccgcaatggcgtgacaaagcgatcgggttatgtgttggcaaaagatagcgggctaatcggttttcctgaacgcacacgtgaagcagcacgcagtaagaagcaggatacgccaaataaaaagaaagatgagaaatttgcctttgatcggcaagcgagggacggttggaatgtaaaaagcctgttactgcctatggtaaacccttgtgacaaaatcaagctggaaagtgtgacggtaacaaattggttccgcgtggaaaaaatcaagcattcgggggatagtcattctagcgattggcaaagcgaactacatttagtagatctaaacgcaccgactaaaacgcagatggaaacgcaaagtaaacatcgtaaaaaacgtaagaaaaaggacgattaa

SEQ ID NO: 2146 - DNA, 672 bp, H. influenzae strain 86-028NP
atgacggatattttaaccgcactttctgaaattaatgtgtcattacctggaaaaattgttagttatgatgcggaaacggtgcgagcaacggtacaaccctctattcctaagcggttagccaatggcgaagtattaaatgcaccgcagattgtaaacgtgccggtaatgttccctatggcagacattaacggtgcggtagcacaagtgacattaccagtgaaagcgggagacggctgcttgctgattttttcgcagcgatctctagaaaattggttaagtggaagcaatgatgcgccagatgatccgcgaatgtttgatttatccgatgctttttgtgtaatgggcggtaatagtcgctctccaaatgccgatgttgagaacctttgtattaaatacggtagcggtaaaattaaaatcgcaccaaatggcaatattacgatcaattcgcctgatgtaagggtaacaacggataattttactgtgactgcgacaaccagcacctttaacggcaatgtaatcgtaaatggcggtatttcaacggcaggtaacagtggcagtgtatccgttagtggttctttaacgacaactggcgatgttatggcagatggtgtgtcattacaaagtcacaagcacaaaggcgatagcggtggtacaacagggaaaccattatga

SEQ ID NO: 2147 - DNA, 366 bp, H. influenzae strain 86-028NP
atgatcgatttaaaattgagtggacaacacgatttgatgataaaagatcgtaaactagtacttgtagatggcatcaatcaaaaagcacaacagattaaggttgtgcttttaacgtttttaggagagtggtttttagatacaacaattggactgccttattttgatgaaattttgacaaagaatcctgataacgcacgtattcaatccatttttcgcaaaaagattatgggtgtgaaaggggttctagcggtagagcgtttatctcttgaatttcatctaaaagatcgggtgttggcggtgcaattttcagcacgaaccaacgaaggtgtagtaaaagacaaagtgagtataaaacgaaatggctaa

SEQ ID NO: 2148 - DNA, 1437 bp, H. influenzae strain 86-028NP
atggctaattatggattaacgcgtagtggctttgtacgtaagcgtatgccagagcagttaaaagagctttatgaaaatgcgaagaaaatgtttggggaagatattgatttgtcacctgaaactgtgatgggaatgatgttaaacattgaatcagaacgctttgccgccttatgggagcttattgaaagcgtttatagtgcaatgtatccgattagcgcaaccggagcaaatttagatcgagccgtttcttttacaggagtcactcgtttacaagcagaacattcaacggtgccagtgattttttacggcaatgcaggcgttgaaatcccccaatatactgcagtacgcaatgcaggaacacaggttttatattattcagatgaagacgcacgcattgattcaaatcaagccgcttatgcacggattgagctaaattcaaataccattaatacgggcgatgtattttccgtcgtagttaatggtgtgacgtatcgttttacagcaatgcgttcatcaagtgcgagtattattcaaggtttagccaatcaattaaaagcgataagttatgccgatgtgagtaatgataatgtaattattgagatttcggcacaatctataccgcacttttctatctccgttagccaaaatcttacgctttctcgcttaggcgtgcgttgtatgctttccactgaaagccctagtgaagataaagccgatattgggcaaatgattgaactggtaaatatgattgatggcgttgttgaagtgaacaatgttgttgaaggtgcatccggtcgtttagaagaaagtgatattgaattatatcaacgttatcatcgtggtgtttggcaaaatggagccggtacaattgattcactttatgccaatttaagcaaggtagcgggcgttcattcattgagaatttatgaaaacgatgcagatcagacgattaatggtattcctaagcgttcactgtatgcggtagtcaaaggtggtttagatacggatatcgcatcgacattattaaaatttaagcctttgggtattggcacacacgggcaaaccgaagttactgtgcgagacagtcaaaaccaaccgcacttgattaaatttagtcgtccgactaaatgttacatttggttaaaagttaccattgaaacctttgttgatgaagatgaaattgcgagagctggttacattgtaagtgcactcaacaatatcttgaaatatggtaaatcacttggcgtgggagcagatgtaattcatcaacgccttattgctgcttgcattgcggttcaaggcgtgggaaaagttaccgttcagataggtaaaacgaataatattaccgatccagagccaagataccaagaacagaatatcaccatcgcacctgatgaagaagcgattttcgatccgtctatcattgtgatgagttag

SEQ ID NO: 2149 - DNA, 615 bp, H. influenzae strain 86-028NP
atgaaagatattttaaccgcacttaatgatgattttaagcagttagggcgagagcgattactttctcaatttaattactcgcctaacttaaacgcatttttatcacttcttcttttaccgcatcacgaaattcaagcaaccttaaagcaaatgcttacagaaaggcatattgataccgctataggaaaacaacttgatggcgtaggcgatattgtcggtatgccacgccctttcgctagagtaaatggcgattggtatttcggtttttctggtcaatcaaaggcaaaaccctttagtcgagcccctattcgtgatttagccacgcaaactaattctagagattttaattatatgctcgatgagcattatcgacgattaattaaatggaaagttatcgccaatcattcacatggcacccttgatgatgtaatcgaagcctgtagggctatatttttagcagagcgtgtttcaatcacagaaggacaggatgcagatgtgcatatagcgattacacgaatggcaaaaaatagattagatgcagtagaacaagagccggttttgtggattcccacggcagcaggtgtaaaggtaacggtagaatttataaacgcataa

SEQ ID NO: 2150 - DNA, 2349 bp, H. influenzae strain 86-028NP
atgaagttaaaactaatcgatttattcaaaagaattacttgggcgaaaaacggcgatttaaccgacttttctcaaactaattatgaagcaggctgggcgcatttaggcgatgatacgccaacagtgcaagactttaactatgttcaacaaatgaacgacaaaaaagaccagtggttgtttaatcaattaaaagccgtgttggaaaaagccaatatcgagccaacagaagaaaatgttaattcattgcgtgatgcgattttggcattatcaaaaggctatagcaatcctaaaagcctaacggcagacacagtgaattttattgatgagcaaggtcacactcacgaaatcgctaaagcaaccttgcaacaacaaggcatagtccaacttaccaatgacacggggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagagagcaaagtaggattaaggggcaatgaatcgattcaaggtaccaaaagttttgaatctaaaatcattgggtttcgtggcattggggtggctgattcgcaaacttatgcaaatgctaatcacctcttaaatatgggggcaaatgatggcgacggttggatagagtataaaaaaagtaaccgagttatcggcaccattcgtattcgggcaaatggggaattgtcatataacaatcaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacgtagcaaacggtcaaaatctacccgaaaatggggcatggcatattgaagtagttagcggtggggcaacaaatgcggtgcgtcaaattgcacgtaaagcgaatgataacaaaatcaaaacacgcttttttaatggctcaaattggtcagaatggaaagatgcaggcggcgacggcgtgcctattggtgcagtggtgtcattccctcgtgcggtaactaatcccgttggttttttaaaagcagatggctcaacatttaaccaacaatccttccccgatttataccgcactttgggcgacagcaaccaacttcctgatttaactcgtagtgatgtggggatgacagcttattttgccgtggataatatccctgcaggctggattgcctttgattcaatcagaacaaccgttacacagcaaaattaccctgagttatatcgttacttagtcggtaaatatggttctatttcaaatgtgccattagctgaagaccgatttattagaaatgcatcaaacaatttatctgttggtgaaacgcaaagtgatgagattaaaaagcacgttcacaaagtgagaacacactgggttaattcaagtgatagtaatattttttatgacaaaacgaaaacagttatagattcacgattacgcactgcaactacaactgatgataatctcagtgataatggatttatgcatccgctattagatagcccaatggctacggggggagctgaaacaagaccgcgagcgattgctctcaaactttgtataaaagcaaaaaacacatttgatgacgtgcaattctgggtgaaggctttcggtgttgttgaaaatgctggggctttagatgcgggtacacttgcgcaaaatatgcaagcgttatctgagcgtgttgaacaaaaaatagaagagaataaacaatcaactttgcgagaaatcaccaatgcaaaagctgatataaatcagcaatttttgcaggcacaagggaatttatctcaaattggcacattaaaaacagtctggcaaggtaacgtgggttctgggcaaattactatatcagagaagtgcttcggtaaaacgttaattttatatcttcaatcatcagtaaatcacagccttgatgataataacgatattgaactcgtcagttttgaagtgggtgcagaaattgaaggtaaaaaaggtggcagagttcgttggcttgatgttcgtgaagtaaatgcacacagcaatggtggtagacctatttattatgtagaagtcaagagattcgatgtgactgttgatagagacggtacaacaatacaaattcaaaatcttgctggtcgttttgtaaaacgtattgatattcgatga

SEQ ID NO: 2151 - DNA, 603 bp, H. influenzae strain 86-028NP
atgaaagtctattttttaaaagaaaatttgaatagttatcaaattttccctattcctcaaaacttaaatgattttgtggaaatggaagtagaaaacgaatcagagcttgagactaaacaacttattgattttaaaagtcaatacattctagttgatagacaaccaacagaattacacaaatggaacggaaacagctgggttgttgataaaaaaaagaaaactgaaattaagcgtgaactcattaaaaatctagttgatagcattgatgatacagcagctaacattagtgcaagatggacaaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagcttgcgtacattgcaacaacaattagcagtgcaaagaatgcgtaagtatgagttaaagcatgaggcgttgagtgatgaagaactgcaacgtattcatgacgatattataggtaaaatgcaaacattagcggaggcacaacaatga

SEQ ID NO: 2152 - DNA, 501 bp, H. influenzae strain 86-028NP
atgataggcgctaaaatctatctcgcattatacaaaggtaaaaaaacgggtaaaaacccgagcgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggcggtgtacgttgtaagcaaattgatgtttatgatagagaaaaatgggatttaattgagctagagggagttactgaagcacaaatcaaagcttattttgaccgcactttgggctgtaaatatgactggtggggtgcgttagggattgtgctaggcatcaaacaaaaacgctcaaaatatttttgcagtgaatggtgttttaatgcgatttgcggtagcgagagcggttggagatttagcccaaatcaactagcggctatatttaataaagagaaaagttaa

SEQ ID NO: 2153 - DNA, 450 bp, H. influenzae strain 86-028NP
ttgttcagtgggcaacaagtggcaacgtttgatgacttattccaacataatttctggcattgtattcgtcagtctgattatccaaaggctgatggctatttggacggcgtagagattgtgaaagaatcattccacacgcttttgcctaagtttagcgatgatccgaaagcgttatttgtgttagatccgccttacctttgtaccaagcaggaaagctacaaacaagccaaatattttgacctgattgacttcttgcgattggtcaatatcacgcgaccgccgtatgttttctttagctcaacgaagtcggagtttattcgctttatgaattatatgctggaagataaggtggataattggcaggcgtttgaaaacgccaaacggattacggtcaatgccaagctgaactaccaagtggcgtacgaggacaatttagtctataaattttag

SEQ ID NO: 2154 - DNA, 264 bp, H. influenzae strain 86-028NP
atgacaaattttcaaatgagaaccgagcaggaaatgatgatggaattagcccttattgcagtgaaagaacacgacggttttattgtagacggttcgcaatattcactgcctaacgaatgcgggcaaacttttgtctataacacggcatttttagatgtgcgttttgtggaagacggacgcaaagattgcgtggtgagatttacgtccacgctcgcccctttcgccccaccgttttattgcttgctttccgaattagaagactaa

SEQ ID NO: 2155 - DNA, 1131 bp, H. influenzae strain 86-028NP
gtgtattgcacacatttttatggaataaacaatggcgacaattatcaagaatggcaagcgttggcacgcacaagtgcgcaagtttggcgtgagcaaatcagctactttttttgactcaagcagacgcaaaaaatgggcagaaatgctcgaaaaacagctcgaatcaggaaagtataatgaaatccctgatattacattggatgaactgattgataagtatctaaaagaagtcactgtaaccaagcacgggaaacgtgaagagcgcataagactactgcgtctttctcgaactccgcttgccgcaatatctttacaagaaataggaaaagcacactttcgtgagtggtaaaatcaacgattaaaagaagtctctccagcaacagttttgcgtgaacgtagttcgctttctgctctaatggccaaaacgattgaatgggattttataacagcccccccctaaaatatcttgagaaaccaaaagcaccagcgccaagaactcgtcgatataatgaacatgaaattgagcgtctgatttttgtgtcaggttatgatgtcgaacatattgaaccgccaaaaaccttacaaaattgcacgggggcggcatttctttttgctatagagacagcaatgagagcaggggaaatagcaagtttaacttggaataatatcaattttgaaaagcgcaccgcctttttgccaattactaaaaatggacattcaagcacggtgcctctttcggtaaaagcaatagcgattttacaacatcttacttcggtaaaaacagaaagtgatctgcgagtattccaaatggaagcacgccaactggatcacaacttccgcaagctcaaaaagatggaagggcttgaaaatgccaatttacattttcacgacacccgccgtgaacgattggcagaaaaagtggatgtaatggtattagccaaaatatcgggccatagagatctcagtattctgcaaaatacttattacgcacctgatatggcagaaggctataaaacaaaggcgggttatgatctgaccccaaccaaaggcttgagccaacggaattttttcttctttaatgaaaacttcatcgttttcacaacaaatccaccgatagtcattaagctgtaa

SEQ ID NO: 2156 - DNA, 282 bp, H. influenzae strain 86-028NP
atgacaaaacgttgtgatcagcctatttgtattgagtatgaagaatgcgaaccgaataaatacggtgagattcgtaagaaaattgtgggggtaaaaaacagattcacagaaaagaaaatcatcaccaaattaaaaaactgggtgattaaatcagcgaaaagtgcgttgggttccaccgcacttaattcggagaccaccgaacaaacaaggcgcatcgagccgcttggacttgtgtcaataactgtaaccgttcaaaaattgaacatcaagctaatctattga

SEQ ID NO: 2157 - DNA, 186 bp, H. influenzae strain 86-028NP
ttgcaaattaatgttgatccgaatattgcgccacatcgtatcccttattttgagtttgacacaaaagaatatgaagacttatcggtatttgcagatgccatccctaaacttacgggcattggcgtgcagatttcggaaagttgggtgtgggataaattagggattcctgaaccgcaggaaggttag

SEQ ID NO: 2158 - DNA, 669 bp, H. influenzae strain 86-028NP
gtggaagtagaacgcccagcagataagcaaggtaatcgtgaaaagacggtagggtttaaattgcctgatggcacgatacgtgtgacggataaaggctttgattacaatgtagggcgattaaactacaagcctaatttggatctttatcctgaaaaactggcgcatgcgtttgcgaaggttgagatgaaaggtggggagtttaagcacgattttgagttgttggcaaagcatatggcggagatgaaacaaacgctcagcctagatggaaaaaaactcactgttgatcaaatgttacaggtgcgagatagtcttaccaaaaattttaaatttgcggcaggtgtcttgagtgcggaaagtaaggatttattgaaaagcaaaactggcacagtgtggctttctgatgatactttaattaaacagtttaatagccgtgatgggcaagattttggactggaaagctatgcacttttccctgatttatttaatcagcctgatattgttctacaagataatgatcgtttttattttatcaaaaactttgagaaacagcgtattttaggtgtaataaagcacttatctaaatttaatgaaatttttgtgctttcggcaagggagattaatatcaaggaagtagaaaaaatgaaaggtaaattggcagttatcaagtaa

SEQ ID NO: 2159 - DNA, 147 bp, H. influenzae strain 86-028NP
ttgcatgaatatacccccttaaattttaaaaatcaacaattacttcctcaaatttttatgcgagcaaaagggcgatcgattcgtttgattgggttacatgtcaatttacccgaagaaaataaacaagaacaaatgagcctctggtga

SEQ ID NO: 2160 - DNA, 537 bp, H. influenzae strain 86-028NP
atggaacataaattagaagatattattgcaatttttaatcaatgttttgaagaggaatacaacactcgcttagtcaaaggcggtgatgagcccatttatttacccgcaaatgatgaagtgccttataacgcgatttattttgcgcgaggcttttacagcagtgcattgcacgaaattgcccattggttagtggcaggcaaagaacgccgtaaactagaagattttggttattggtatgagccagatggacgttcagaagaacgtcagcgtgattttgaaaaagttgaagttaaaccgcaagcattagagtggattttggcaacggcggcaggtttccgttattttgccagtgcggataatttgaatggcaatccgggcgatacacagccttttaaacaagccgtgtatgaacaagtgaaaatctatgcggaaaaaggtttaccaaaacgagcggaaatgttacgcaaggcgttagtggcattttatggcacagaagatgaaattgatctggcgaagtttgatgtcgtgcgtatttaa

SEQ ID NO: 2161 - DNA, 447 bp, H. influenzae strain 86-028NP
atgcgattcacaaaaacactttttaccaccgcacttttaggtgcttctatcttttcttttcaatccaccgcttgggcggatacgctggaacagcaattccaacaaggttctgaagccactacgagaggcgattatcaaaccacctttaaatttttgttacctctggcggagcagggaaatgcagaggctcaattgatgttgggcgtgatgtatgcaagaggaataggcgtcaaacaagatgattttgaagcggtgaagtggtatcgccaagcggcggagcagggatatgcaaatgctcaagctatattgggattctcatatcttttaggacaaagcggtgttcaagtaaataaatctttagccaaagaatggtttggtaaggcttgtgataatggtgatcaaaatggttgcgaatattatggcaagttaaatagaggggagctctaa

SEQ ID NO: 2162 - DNA, 177 bp, H. influenzae strain 86-028NP
atgccaactttacaatgcgaattttggaatgtagggcaagggttattttcaagtgggcgtattcaaatgggagacgccccagcctttcattgggtttatggtttgcaagttcctcatcatggttcaaagccaattttagtgaataaaaataaaagattatccattcattcaatttaa

SEQ ID NO: 2163 - DNA, 660 bp, H. influenzae strain 86-028NP; identical to SEQ ID NO: 724

SEQ ID NO: 2164 - DNA, 177 bp, H. influenzae strain 86-028NP
atgccaactttacaatgcgaattttggaatgtagggcaagggttattttcaagtgggcgtattcaaatgggagacgcccaagcctttcattgggtttatggtttgcaagttcctcatcatggttcaaagccaattttagtgaataaaaataaaagattatccattcattcaatttaa

SEQ ID NO: 2165 - DNA, 555 bp, H. influenzae strain 86-028NP; identical to SEQ ID NO: 726

SEQ ID NO: 2166 - DNA, 177 bp, H. influenzae strain 86-028NP
atgccaactttacaatgcgaattttggaatgtagggcaagggttattttcaagtgggcgtattcaagtgggagacgcccaagcctttcattgggtttatggtttgcaagttcctcatcatggttcaaagccaattttagtgaataaaaataaaagattatccattcattcaatttaa

SEQ ID NO: 2167 - DNA, 552 bp, H. influenzae strain 86-028NP; identical to SEQ ID NO: 728

SEQ ID NO: 2168 - DNA, 1086 bp, H. influenzae strain 86-028NP
atgatgaaagattccattattgcaaaattagaaagtttaaaagaacgttatgaagagctagaagccttattgggcgatgtttctgtaattagtgatcaggataaattccgtgcgtattctaaagaatattcgcaacttgaagaagtagtgaaatgttttaatcgttggacgcaattaaatcaaaatattgaagaagctgaaatattgctcgacgatcctgaaatgaaagaaatggcgcaaatggaaatcgaagaatccaaagcggaaattgaagaagtggaacaacaacttcaaattcttttactgccgaaagatcctaatgatgaatataactgctatttagaaatccgtgcgggaacaggcggtgatgaagcaggtatttttgcgggtgatttattccgtatgtacagccgttatgcggaaagtaaacgctggtgtgtagaaatgctcagtgccaacgaaagcgagcagggcggttataaagaagtgatcgtaaaagtaagtggcgaaggcgtgtatggccagcttaaatttgaatcgggcggtcatcgtgtgcaacgtgtaccaaaaacagaaagccaagggcgtatccacacgtctgcttgtaccgttgcggtaatgccagaattgcctgaatctgaaatgccagaaattaatccagcagatttacgtattgatacttatcgctcatcaggtgcaggtggtcagcacgtaaatacaacggattctgcggtgcgtattacacatattccaacaggcattgttgtggaatgtcaggatgagcgttcacagcacaaaaataaagcgaaagcaatgtcagtattagcgtcacgtattgttcaagcagagcaagaacgccaagccgcagaacaaacagatatgcgccgtaacttattaggttcgggcgatcgttctgataaaattcgtacatataattatccgcaaggtcgagtaaccgatcaccgtatcaatctcactatttaccgtttggatgaagtaatgaatggtaaaattgatgaactgattcagccgattattacggaatatcaagcggatcagttggcggcattgtctgaacagaattaa

SEQ ID NO: 2169 - DNA, 471 bp, H. influenzae strain 86-028NP
atgtcctttttaactttaaaaggaaataaaatgatcattgaaaatcaaaaagatgctgaattttcttctgctttcaaatcttctcaacctgctcaagcaagccgttttaaacgttggcttgcgagtatgattaatgggcttgtgctttgggtgatggctggtctcggttttgcattgggggattttgccggtgtagtggggatgattgtatatgctggttttcagttatatttcatgaaaacttatggtcaaacaatggcaaaacgctggttaggcttgcgcgtatttaattatcataccaatcatcctgttgaatttggtaaatacatcggtcgtgagattattgatattttattggcatggacaagtttcttattgattattagcggtattgttgcacttgtgcgtgatgatcgccgttctttaacggatttagtggctggcacgatggtgttaaaagacgaaaaataa

SEQ ID NO: 2170 - DNA, 879 bp, H. influenzae strain 86-028NP
atgaattataaagaatggctggcacaagcgattgtagatttagcacaaaaaaatcccactgaaaatagtaaaattgatgcacttgtgcttcttcaacacgctactggcaaatcgcgtacgcaaatccttgcttttgatgatactgagattgatgaaaaagtgcggttaaaattgaccgcacttttagatcgtcgtctaaaaggcgaacctatcgcttatattcttggtgaaaaagaattttggtcgttaccattaaatgtttcaaaaagcacattgattccaagaccagacacggaaagtttagtggaaaaagcattacaaattgcgttagaaaaactggaagaaaatccaccgcactttcgtattcttgatctcggcactggcacaggcgcaatcgccctcgctttggcttccgagcttgagcccatttgccaaaagcggcatattccgctggaaataattggtgttgatcttatgcccgatgttgtggcattagctcaatctaatgcagaaagaaatcagctaaatgtagaatttttgcagagccgttggtttgataatataacagggaagtttgatcttatcgtcagcaatccgccttatattgatgcgcaagatgaacatttgcatcaaggcgatgtacgttttgaacccctttctgcattagttgccaatgatgcagggtatgctgatttacgtcatattattgaattagcatcgagttatttgaattctaatggcgtattattgcttgaacacggatggcaacaaggagaaaaagtgcggtcaattttccaagaaaatcattgggaaatggttgaaactgtgcgtgattatagcgacaatgagcgtgtcactttaggtttttggaagaagtaa

SEQ ID NO: 2171 - DNA, 804 bp, H. influenzae strain 86-028NP
atgaaatattatcgacgtgcgttatacgataaatttgtgcatttttatcttgttatctctgatgatggcagctcagaagcacaacttcggggaaaaatgggtgggcttgtgcgtaaagcgcgtaaaaaaatttcgccagattggccgaaagaagagcagattcatcagttactacagctattttatggtgattggggctttcattgcgatccagaagattatttttatgctcgcaatttatatttgccttatgtgtttgaacatcgtcaaggaatgccagtgactcttggggcaatggtgttttatttagctgaggcattggatttgccaatttacccagtaaatttcccaacacagttaattttacgtgctgaagtcagagatgaagtggcttttattgatccttgggatggcacttatatttcacaagaaaaattgcagcaactttatgaaggtgcatttgggtttggggcgaaaattcaacccgaagaacttgatagagccgatctttctttactttattctcgctttgagcaactggcgaaaaatgcgcttattcgtgaagagcataacgatatggcatatcactatattaagaatttaatgattactgatgctgaaaatccttatcatatccgtgaccgtggcttagttttagctcaaatgggggcttatccttcagcattgaaagatttagaattttttgtggaacattgtccaaaagatccaacggcggcgtttatccgcacgcaacttttagaacttaaaggcgagattaataaagatacttttcccctccattga

SEQ ID NO: 2172 - DNA, 855 bp, H. influenzae strain 86-028NP
atgcaaaataaaattgtaaaaattggcaatattgatgttgcaaacgacaaaccttttgtgctttttggcggaatgaacgtgctggaaagccgtgatatggcaatgcaagtgtgcgaagcttatgtgaaagtgacagagaaacttggcgtgccttatgtatttaaagcgtcttttgacaaagcgaatcgttcatctattcattcttaccgtggacctggcatggaagaaggattaaaaattttccaagaattaaaagatacattcggggtaaaaattattaccgatgtacacgaaatctatcaatgtcagcccgttgctgatgttgtcgatattattcaacttcccgcctttttggcgcgtcaaacagatctcgttgaagcgatggcaaaaacaggcgcagtgattaatgtgaaaaaaccacaatttttaagcccaggtcaaatgggcaatatcgtggaaaaaatcgaagaatgtggtaatgataaaatcattctttgtgatcgtggaacaaattttggttacgataatttaattgtggatatgcttggctttagtgtaatgaaaaaagcctctaagggtagccctgttatttttgatgtaacccattcacttcaatgccgtgatccatttggggcagcatcgagtggtcgtcgtgcgcaagtaaccgaattagcgcgttcaggtttagcagtaggcattgcaggtttattcttagaagcacatccaaatccaaatcaagcaaaatgtgatggcccttctgcattgccactttctgcgcttgaaggctttgtttcccaaatgaaagccatcgatgatttagtaaaatcttttccagaattggatacctcaatttaa

SEQ ID NO: 2173 - DNA, 948 bp, H. influenzae strain 86-028NP
atgaaaatcgtatttttagatagcacggctattcctaaacatatttcaattcctcgcccaagttttgaacatacttggactgaatatgatcatacgtcttctgccgaaaccattgagcgagcgaaggatgcggacattgttattaccagcaaagtgatttttgatcgtgaaactttgcaacaactgccaaaattaaagctgattgcgattactgcgacaggtacaaataatgttgatcttgtggctgcagaagaaatgggcatcgccgtgcgtaatgtgacaggttattccagtacaaccgtgccagaacacgtaatcggtctgattttttctttaaaacacagtttggcaggttggttacgcgatcaaacggaagcaaaatgggcggaaagcaaacaattttgttattttgattatccaattacagatgtgcgcggttcaacgttgggcgtatttggtaaaggttgcctaggaacagaagtggggcgtttggctaatgccgtgggaatgaaagtgctttatgcagaacataaagatgctactgtttgccgtgaaggttatacgccttttgatgaagtattaaaacaagcggatattgtgacgttgcattgcccattaacggaaacaacaaaggatttaattaatacagaaaccttatccaaaatgaaaaaaggtgcatttttgattaatacagggcgtgggcctttgattgatgaacttgccttagttgatgcgttaaaaacggggcatttaggcggagcggctttggatgtaatggtaaaagagccaccagaaaaagataatccgttaattttagctgcaaaaacgatgcctaatttaattatcacaccacatattgcttgggcgagtgatagtgcagtgacaacattagttggcaaagtaatgcaaaacatcgaagaatttgtacaacaattacatcaaaaataa

SEQ ID NO: 2174 - DNA, 1182 bp, H. influenzae strain 86-028NP
atgaattttcctatttctctttatattgcactacgttattggcgtgcgaaaagtgcggatcgttttgggcgattagtaactaatcttgcaagcctggggattgtgctaggtgtgatggcattgatcatcgtgctttcggtgatgaatggattagaaggttaccaaaaacaacaggtgctatcttccattcctcatgcgattgtgagcgaagaacagcctatttctacagaaaaaacgctagaaaatttaccgcactttgtccaaaaagccgtgccgatcaatacaacaaatgtgatttatcaaacggcaaaaggcgtaagtgcaggacaaattataggtattcaatcattttctgatgatcctttggttgaatcttttgatcagactaaatttaatgaaattttgcctagaggggagtttaaactggtcattggtgatcaactggcgcaaaaactgggcgtgaatattggggataaaatccgtttgatgattacggaaaatagccaatatacaccattcggtcgggtgccaatgcagcgtttatttactgttagcgatatttattatggttatggcgaagcatctggttacgaagcctttgctaatattacagatattggtcgcttaatgcgtattcaacctcagcaagcgcagggctatcgtttatttctgaatgatccgttccaaattacagaactcccacaacatttcccgacacaaaaaatcacagattggcgtgtgcaaaaaggcgaatttttccaagcagtgagaatggaaaaaaatatgatgggtttgctgattagtttgattattgtcgtggcgatttccaatattgtcacctctttaagtttgatggtggtggataaacaaggggaaattgcgattttgcaaactcaaggcttaacaaaatcccaagtgcgttcagtgttcatttatcaaggattactggtgggatttgttggcacattactcggtgctattttaggtgttttagctacgttgaatttaacggacattgtaagtgcggtaaatccacaaggtgtttttttaccgacagaattatcctttgttcaaatgatttttgtcattggattttcgctgttactttccttgctttcaaccctttatcctgcttatcgagctgcgaaagtagaacctgcagcagctttgagatacgagtaa

SEQ ID NO: 2175 - DNA, 1293 bp, H. influenzae strain 86-028NP
atgatggatgaacaatcacttttagcttttgatacacaacatatttggcatccttattcttcagtttcttctgatatgccgctttatgcggtggaacgtgctgatggtgtgatgataactttaaaagatggtcgtcgtttgattgatggtatgtcctcttggtgggcggcgttgcatggttataatcatcctcgtttaaatgcggcggcacagaatcaattagcaaaaatgagccatattatgtttggcggatttacccatgaccctgcggtggaattagctcaattattggtacaaattttgcccaatggattagataagatcttttttgctgatagtggttctgttgcagtggaagtagcgatgaaaatggctattcaatatcagcacgctaaaggagaagtacaacgacaaaaatttgccactattcgttcaggttatcacggcgatacgtggaatgcgatgtcagtgtgcgatccaaccacagggatgcatcatttatttcatcatagcctgcctgtacaatattttcttcctcaacccaacattccatttaatgaatcttggaatgattgtgtcattgaacctttagctgatttacttaagaaaaaaggtagcgaaatcgccgcactgattttagaacctgttgtgcaaggtgcgggtggtatgtatttttattcgccaacttatttagtgaaagcgcaagcgctttgtaaacaatatggtgtattgctgatctttgatgaaatcgccacgggatttggtcgaacagggaaattatttgcagctgaacacgcaggcatttcgccagatattatgtgtatcggtaaagcattaacgggtggttatttaactttatcggcaagtattacgaccactgaaattgcgcaaattatttgtagcggtgaggctaaatgctttatgcacgggcccacttttatggcaaacccgttggcttgtgcaattgcagcggaatctatccgtttattgttggaaagtccttggcagcaaaatattcagcgaattgagcattccttaaaacaacagctttcgcctttagctgaaaaagattacgtcaaagaagttcgtgcattaggggcgattggggtggttgaaatgaaaagtgcggtaaatatgaaaactttagttccacgttttgtggaacaaggtgtttggattcgacctttcggaaaattggtttatgttatgccaccatttgtgattaaagatgatgaacttcagaaattaacggaaggcatgattttggctttaattcaggaatatgaacattag

SEQ ID NO: 2176 - DNA, 1140 bp, H. influenzae strain 86-028NP
atggatgctttcaaacagcaactggaacagcttagcgcacaaaatcaatatcgttcaattccagatttagttcatcaaggacgatatattatgcgagaaaatcgcaaaatgctgaatatgtcatctaatgattatttaggtttggcatcaaatgaaaacttgcgccagtcttttttacagcaatacggcggtaatttcccctcttttaccagttcttcatcgcgtttattaacgggcaactttcctatttataccgatttggaagagcttgtcgcacaacgtttccaacgggaaagtgcgttattatttaacagcggctatcacgccaatatcggcattttgcctgctttgacgacgaaaagtttgattttggcagataaattagtgcatgccagcatgattgatggcattcgtttaagccaatgtgagttctttcgttatcgtcataatgattatgaacatttgaaaaatctgcttgaaaaaaacgtcggaaaatttgaccgcacttttatcgttaccgaatctgttttcagtatggacggcgacgtggcggatttgaaacagcttgttcaattaaaaaaacaatttcccaatacttatctttatgtggatgaagcccatgcaataggcgtttacggtaaaaacggattaggtattgccgaacgagctaatgtgatagctgatatagatttgttggttggcacttttggcaaggccttagcttcaatgggggcttatgtcgtctgtgatcaaatattaaaagaatgtttgattaatcaaatgcgcccattgattttttcaaccgcattgccgccgtttaatgtggcttggacttattttatttttgaacgattgccgcaattctcaaaagaaagaagccatcttgagcggttaagtgcatttttacgccaagaagtggaacacagaacgcaaataatgccaagccaaacttgcatcgttccctatattttaggcgaaaacgaagcaacccttgctaaggcgaaagatctgcaagagcaaggttattattgtttgccaatcagaccgccgacagtaccaaaaggtacatccagaatacgattgtctttgacggcagatatgacaatggatgaagtgaaacagtttgtggcatgcttataa

SEQ ID NO: 2177 - DNA, 648 bp, H. influenzae strain 86-028NP
gtgaaaacgaaattttatgatcatcaaggtgagcatttaatagtttattttgctggctgggggacacctcttgatgctgtagttcatttgattttgccaacagatcatgatttattaatttgctatgattatcaagatttaaatttggattttgatttttccgcctatcggcacatccgtttggtggcgtggtctatgggcgtttgggcggcagagcgagtattacaaggaatcaccttacaatcagcaacagcagtgaatggaacaggtttaccttgtgatgatagcttcggtattccctatgctatttttaaaggtacgttagataatctcacagaaaatactcgttcaaagtttgaacgtagaatttgtggtgacaaagtatcttttgaacgttatcaacaattttctgcacgaccatttaacaaaattcatcaagaactcaccgcactttttgcgatgattcagcaggataaacgcacaaatcttattcactggacaaatgcatgggttagttctcgcgataaaatttttacgccagccaatcagaaccaatattgggcatcccgttgtgccgttcagaaaatagagggtgagcattatgtgttttcaagatttacccactggtcggcattatggaatcattaa

SEQ ID NO: 2178 - DNA, 783 bp, H. influenzae strain 86-028NP
atggaatcattaacttccgtaaataaatcgcgtattcaacaagccttccaaaaagccttaaatagctatgatgaacatgcgttaattcaacaaaaaatgaatattaagttaatgatgcatttgcaagactatttaccaaatgggtcattagatagcgttttggaactaggttgcgggtctggtatgttgagtacgttgttgcagaaacagatttcagccaactattggttatttaatgatttgtgcgatgtgcgcactctactcactgaaaagctgattcaaccctttgatttttattgtggtgatgcagagaactttccttttcaacgacgatttgacttgattgcaagtgcatccgccgtgcaatggtttcaccaacccgacgcttttatcgcccattgcaaaacaggcttgaaaacaaacggattattggcggttgcaacctttggcgaagacaatttgaaagaagtccgccagatcacaaatataggattaaattacccgactttatcccaatggcaaaattggttagccaatgattttgagcttttatggtgtgaggattttaatgtaatactagactttgatacaccattggatgtactcaaacatctgaaatataccggtgtaacagcgactaaccaaaaaaattggacaagaaaaaatctcaatggatttattggcgattacttgtcggcgttcagtatgccgtcggacaaagtgcgcctgacttatcatccgttattttttatcgcacgctattctcacatagaaaatcagtaa

SEQ ID NO: 2179 - DNA, 642 bp, H. influenzae strain 86-028NP
atgggcaaggttatttttatatctggcattgatactgatgtgggaaaaacgattgccacaggcatttatgctaaaaaattgatggaacaaggctgctccgtgattacacaaaaaatgattcaaacaggctgtaaaaatatcgctgatgatttacttgtgcatcgaaagattcaagacattgatttaacggaagaagatttacaaggcaaaacctgcccttatgtttttgaatatccttgttcgccacatttagctgcaaagcgagaaagtagaaaaattgaagcaaaaatccttgaaaaatctaccgcacttttggcagaaaaatatgattatgtactattggagggtgctggtggcttaatggtaccttattgtgaagaagagacgacgttggattatatccagttaaataattaccctttaattttagtgacatcgggaaaactaggcagtataaaccatacattattaagtttagaggcttgtcgtactcgaggtatttcagtattaagtgtaatgtataacggttacccagaatatgatcctattattagtcaagaaacccaacgctatttaaaacgttatcttgaaaaacattttcctgaaacaggatttgaatactttgggtgtattgaaatttaa

SEQ ID NO: 2180 - DNA, 684 bp, H. influenzae strain 86-028NP
atgaacaactatttattaaaatgcgaaaatatcaataaattttatcaagagggcgaaaatcaaacgcaagtgttaaaaggcgtttctttttctatggaacctgcagagttggttgcgattgtggggagttcaggttcagggaaaagtactttattacatactttagggggacttgatcagccaagtagtggggaagtgtttattaatggacaatccttgcaaaaagcatcggctaatgaattagctgctttgcgtaatcgttatttaggatttgtgtaccaattccatcatttaatggcggattttaccgcacttgaaaatgtgatgatgccgatgttgattggtcatcaaaataaaactgaagcgaaagatcgcgctgaaaaaatgctaagtgcggtgggattaagccatagaattacccatcgtccttctgcgctttctggtggggaacgtcagcgtgtggcgattgcgcgtgctttagtgaataatccatcgttagttttagcggatgaacccacaggaaatctcgatcacaagaccactgaaagtatttttgagctgattcaacaacttaatcaagaacaaaatatcgcctttttattagtcactcacgatatggggcttgcggaaaaattatcacgccgtttagttatgcaagatggtcttttgaaggagggggcgtga

SEQ ID NO: 2181 - DNA, 1251 bp, H. influenzae strain 86-028NP
atgaatacgccgttttttattagctggcgttatcaacgtggcaaacaaaaaaatcctttagtcgcgttaattgcaaaattctctgcaattggtattgcattgggtgttgcagttttaattgttggcttaagtgcgatgaatggttttgagcgtgagcttaatcaacggattttggcagtcgtgccgcatattgagattttttctgcgcatcaagcgaaagatcccacaattcatcattggcaaaatttagaaaaacgcctacaacaaaatccacaaattaaaggaatctctccttttgttagctttacggcattggtagaaaatggctcaaaattgaaagttgttcaggtcaaaggtgttgaaaaacaagcagaagataaggtaagttcaattggcaattttgtacaagagcaaggttggaacaaatttgagaaagaaggcggattggtcttgggagcgggtatcgctaaagaacttgatgtaaaagtaggggattggattaccttgcttatttctcagcaaaacggcgatgaacaatttgctcaaccaactcgtgagccagtgcaagttaccgctattttacgcttagatggtcagcttgattatagttatgccttattgccgcttgctcaagcacaaacctttttgacttatcaacctgatcaaattacaggtgttgaattgaaattagatgatcctttttctgcgagaaatctggatttatcaatgcttaatgattatccgcagatgctatatatgcaaaattggattagtaaatttggttatatgtatcgcgatattcagcttattagaaccgtaatgtatatcgcaatggtgcttgtgatcggtgttgcgtgttttaatattgtttctacgctgattatggcggtaaaagataagcagggcgatattgccattatgcgcacgcttggggcgaataatgcgtttatcaaacgtatttttatttggtatggcttacaggcaggaatgaaaggttgtttaattggaattgtgttaggcattatacttgcattaaatcttacaacctttattcaaggtattgagtgggttatcggtaagaaattattatcgggcgatgtgtattttgtggatttcttgccaagcgagttacattggttggatgttttgatggttttagttgcagcacttgcattgagtttaatggcaagcctttatccagcaagccgagctgctaaattacaacctgcacaagtattaagtagccattaa

SEQ ID NO: 2182 - DNA, 1089 bp, H. influenzae strain 86-028NP
atggctaaagagaaaattgaaattgtcgtggcaaacgacgatacgcgaattgaaaaagtcgatcaggtgttaccacccattgccttattagaaaaatacccagcaagtgaacaggctgcggcgttagtgaagcaaactcgtcatgaggcacataatattattcatggtaaagatgatcgtttattagtcgtgattgggccttgctctattcatgatccgaaagttgccattgaatatgcgactcgtttaaaaccattacgtgaaaaatacaaagatagccttgaaattattatgcgtgtgtattttgagaaaccgcgtacaacggtgggttggaaaggtttaattaatgatccatatttgaatgatacttatcgtttaaatgatgggttacgcattgcacggaaattactttcagatattaatgatcttggtgtgcctgcagcgggcgagtttttagatatgattacacctcagtatttggcagattttatgagctggggggcgattggggctagaacaacagaatcacaagttcatcgtgagttggcttcaggtttatcttgtgctgttgggtttaaaaatgccactaatggtggtgtgaaagtcgctttagatgcaattggtgcggcggaagctccccactatttcttatctgtcactaaatttggtcattctgcaattgtttctacaaaagggaatgaagattgccatattattttacgaggtggagataaaggtcctaactatagtgctgaagatgtagaaaaagtttgtgctgatattgaaaaaacagggcgtattccacacgttatggttgattttagccatgcaaacagcagtaaacaatataaaaagcaaatggatgtttgccaagacgtatgtaatcagattgcatttggttctaaacaaatctttggcgtaatggtggaaagccatttagtggaaggtcgtcaagatttagttgatggcaaagcgcagacttatggacaaagtattacggatgcgtgcattggatgggaagattctgaaagattattgcaacaactttctgatgcagttattgctagacgtaaagcgacgagtaattaa

SEQ ID NO: 2183 - DNA, 441 bp, H. influenzae strain 86-028NP; identical to SEQ ID NO: 700

SEQ ID NO: 2184 - DNA, 1245 bp, H. influenzae strain 86-028NP
atgaacacatcacgtctatttagtctgttatttcagggtagtttggtaaaacgaattgccgctggcttggttcttggtattgttgttgcattgatttcagcaccattacaagaaaccattggttttaatcttgctgaaaaagttggcgtattaggtacgatttttgtaaaagctctgcgtgccgttgcaccaattttaattttctttcttgttatggctgcccttgcaaaccgtaaaattggtacgaaaagcaatatgaaagaaataattgtgctttaccttttaggcacattcttagctgcatttgttgctgttattgctggtttcgtattcccaacggaagttgtacttgcaaccaaagaagatgcaagctcagcaccgcaagctgttggccaagttttatttacccttatcttaaacgtggtagataatccattaaatgcaattttcaaagcaaactttattggtgtattagcatggtctatcggtttaggtttggctttacgtcatgcatctgatgcaactaagaacgtattatctgattttgcagaaggcgtatcaaaaattgttcacgtgattatttcttttgcaccatttggtgtattcggtttagtggctgaaaccttatctgataaaggtttagtcgcattaggcggttatgtgcaattacttgctgtattaattggtacgatgttatttactgcttttgttgtaaatcctattttagtttattggaaaatccgtcgtaatccttacccattagtgtggacttgtgtacgcgaaagtggggtaactgcattcttcactcgtagttctgcagcaaatattccagtgaacattgaattagcaaaacgcttaaatcttgatgaagaaacttattctgtttctattccattgggtgcgaacattaatatggcgggtgcggcgattactattactatcttaactttagccgcagttcatacactaggcttagaagtttccttcgttagtgcgcttttattaagtattgttgcagcactttgtgcttgtggtgcatctggcgtagcgggcggttcattattattaatcccattagcatgtagcttatttggtatttctgatgatgtagcagcacaaatgatcggtgttggttttattatcggtattttacaagactcaaccgaaacagcattaaactcatcaactgacgtattatttactgcggcagtatgtatggaagaagaacgtaaaaacgcagcataa

SEQ ID NO: 2185 - DNA, 609 bp, H. influenzae strain 86-028NP
atgaatcacttaattatttttgctcaccctaattcagtgcgtagttttgggcgagcgattgccaatcgtattgagcaaattagtcaagaaaatggtgtaaatgtattttttcgtgatctttatgaaatgaatttcaatccaattttatctcatgaagaattgcagaatgctaacaaaggtattattccagaagatattcagcaagagcatgattttattcttcaagcagatttaattacgttggtttatcccctttggtggatggggttcccagcaattttgaaaggatatttagatcgcgtattaagtcacggttttgcctataaaacggaaaacggcgaatcagtggggttgctaaaaaataagcaaatgcagcaatttattacgattggcagtaatgttgatcaatataaagaatttggtgtggataaatcgcttaatcattgtttgattaatggattattcaattattgtggaattgaaaatgtcgagtttgaattatttggagatattcatttaattgatgatgaggctcgtaaggcgatgattgaacttgctgctcaaaaaactcaagcaaaattgaccgcacttttaaaggaaaaagagtaa

SEQ ID NO: 2186 - DNA, 555 bp, H. influenzae strain 86-028NP
atgtctgaaaaacaaattaataatttttcattaattagtcgattattcggtaatcttttttatcgttctccaacagataaagtactcgctgacgcatttgtttggttacaacaaaaaggtttgagtcaagtttgggcgttagatactgataaagaaagtgaattagcactgaatagcttgcaagttaaaatcgatctcaatttattgaacgaagagtatcaaaaattatttggtgcgaatgggaaagtgatgacggctatttcagcttatggcattgatgttgaagaatttgtgaattttcgccttgtacgcaatatgccagaggtggaaagtgcggatcattttgctttattattgctcactgcttcttggcttgaagataattcggattctttagtggctcaacaagaattctttgaaacttttttactgccttgtgcagcgaagtttttaactcaagttgaaacgcaagcaactttgcctttttatcgtgcattggcccttcttacacgagaaatattggcagcgatggcggatgaattggaagaagagtag

SEQ ID NO: 2187 - DNA, 555 bp, H. influenzae strain 86-028NP
atggatgcacttacacttttaaccacaagaaaatcaaacaaaaaattgaccgtacctgcacctaatgcagaacagcttgagcgtattttcgaagcagcaatgcgtgtgccagatcacggaaaattacatccttatcattttattgtaatggaaaatgagagcttaaataaattagaaacgctacttaaagctgccgttgtagaatttgatcttggggaagaaaaattgatgaaagccgaaaacctagcacatcgcgcacctatggttattggcgtggtagcaaaaatcgatccaactatcgctaaagtgccagattgggaacaaatgttgagtgcaggttgtgcaacttatggattacaactggctgcacaagcacaaggatttgataatgtgtggatttcagggaaatgggttaatggcactgcattacgagaagcgttcggatgtcgtgaacaagatcgtgtgattgcgttagtcatgattggcacaagtatggagaaagccgaacgtgaatgccgtattattgatacaaaagattttgtaacctatctataa

SEQ ID NO: 2188 - DNA, 1848 bp, H. influenzae strain 86-028NP
atgtttcgagtattaaaattttgttggaaagtgctgtgtttcattcgtgatcttgtgatgaatgttgtgtttttaggctttgtactattgctagtggcgattattagcttttcaagtggcgggaaaaaatctactgcattaacgagcgaaggcgcattattgctcaatttagatggttatttagcggacaaccgagatgaaacacttcgttggcaagatgcgttaagcgaattgaatggcgagcatgtccctagaaaaatttcgacgtttgatgtggtatttgccattcaacaagcggaagatgatcctaaaattaaaggattagtgctagatcttaattattttgaaggggcagatttacccgcattagattttattggtggggctatcagtcactttaaagatgcagggaaaccagtgatcgcctatgcagataattattcacaaggacaatattatttagcgagctttgctgatgaaatttatttaaattcaattggaagcgtggatattcacggtttatcgcaagagaatttgtattttaaagagatgctagacaaattagccgttacaccacatattttccgcgtggggacttataaatcagcagttgaaccatttttacgcaacgatatgtcggctgaggcaaaagcaaatatgcaacgttggttaggcgaaatgtggaataattatgttttatccgtcagtgaaaatcgtaatattaagaaagatcgcattttgccgaatgcgaaacagtatcttgcagaacttaaagcgttaaaaggcaatagtacggcatatgcacaacaacgtggattagtaactgatgttgtaactcgtttagatttagataaaaaatttaccgcactttttggcaaaggaagtgatggaaaagcgaaccttatcgaatttgatgattatttgactcaactgcctgatcgtttagaacattacaacgtaccgaataaaattgcggttgtgaatgttgaaggaacgattattgatggagaaagtgatgaagaaaatgctggtggcgacaccattgcgcgaattcttcgtaaagcccacgatgacaattctgtgaaagccgtgattctacgcgttaattcacctggcggaagtgcttttgcttctgaaattatccgacaagaaactgaaaacttacagaaaattggaaagcctgtcatcgtatctatgggtgcaatggcagcatcaggtggttattggatttcatccactgcagattatattattgccgatgcaaatacaattacgggttctatcggtattttcacgatgttcccgactttcgaaaatagtattaagaaaataggcgtgcatgcagatggtgtttcaaccactgaattagctaatacatctgcgttttctccattagcaaaacccgtgcaagatatttatcaaacagaaattgagcacggttatgacagatttttagaaattgtcagcaaaggtcgtcagctttctaaaacacaagtagataaactggctcaaggtcaggtttggttgggcagtgatgcattccaaaatggtttagtggatgagatcggttcttttaatgaagcagttaataaagcagagcaattagtgaatcaacgccaagatactgccgtgcaggattttagtgtggaatggtttacagatgataatgttagtttaattagcaccttattacgcgatactaaaaaaggtacgcaagagcagttagttaaatggcttggtctgccggctccaattcaaaaattacaaaaagaattgaatgtattaactaaatttaatgatcctaaaggtcaatatttgtattgcttgaattgtggaaaggttcagtaa

SEQ ID NO: 2189 - DNA, 798 bp, H. influenzae strain 86-028NP
atgaaaaaattaacgctcagagaacaacaactcgtttgtctcaatatattagattatttccacgcattatgtgagcgacaccaaattcactattctcttggtggtggaacattaatcggtgcaatacgccacaaaggctttatcccttgggatgatgatattgatgtttatatgcaccgtgatgaatatcaaaggttcgttgatgtttggtttcaagaaactcacgaatactacaatatggaaacggcagaagatatacttgctcaatataccggtgaaatggcaaaaattttcgattgtcgcactcaaataacagatgctaagggaagaaaaagcccgatgtttatggatatatttatctacgatggtgtaccgaatgaaccaaagatcatttacccactgatgaaaaagcaccgaagaattaaacttcgattttcttcttgtaagaaaagatggttaagatcaaaagaaaatactttgcaaagaacgatacttggtaaattaagccactttttattttccaaaatgcaaaaaaatttagcacaattccaaataaaatatccgataaaacaatgcgattatattggtcttgtattatctgactacggtggttggcaaaaatcttatatgccgaaagaatattttaatcacattgtttataaagaatttgaaggacgacaatttcaagtaatgaatggatatcacgaacacttaacgcaatattatggagattatatgaagcttccaccagaagaagaccaaaagccacatcatattcaagaagcgtatattttgtaa

SEQ ID NO: 2190 - DNA, 702 bp, H. influenzae strain 86-028NP; identical to SEQ ID NO: 633

SEQ ID NO: 2191 - DNA, 879 bp, H. influenzae strain 86-028NP
atgcgtggctatctctttggcatactgtccgctgtattttgggcattatctggattgttatataatgaattgccattaagtgaatatgatgcattagggaaaataatttcattgctttttttaattgatttttgctcgttattagttatcggcataacattatggcgaaaaagtgcggtagattttcaaggcgttttttggcaacctgcgttatctggcgtattaggtgggccaataggaatgtctgcctatttattaagcattcattatttaacgatctattatgcggcaccgctttcatctctctttcctgttttcgctgcgttaatgtcttattggattctaaaagaaaaaatctctagaacagcgcagtttggatttggattggcggttattgcttctgcattgttggctattgaagtcgggcaaaaagcaaacttcaatacaagcggtctcatttttttagccatttgcatattagggtggtcatctgaaatagtgatatcctcctatacaatgcgttctctctctggacttcaggtgtattttttaagactatgtggttcaactattggttatttattgattctatttattctttccttgaaaaatttctcactagatatacttagttttaattatgtacaaattgctggtgtaataatctttggtgcattatcttactgctgctattaccaagcgatttatctgttaaaaccaatcaaagcaatggcattaaatatcacatattctgtatgggcaattggacttggttatctgctctataaacagccaattaagcccattaccttactactcaccttattattaagtgcaggagtgatcgttacactttattacaaaggggaacaaaaatga

SEQ ID NO: 2192 - DNA, 960 bp, H. influenzae strain 86-028NP; identical to SEQ ID NO: 710

SEQ ID NO: 2193 - DNA, 2013 bp, H. influenzae strain 86-028NP
atgacctttagcgtgcaacatgctgagattcacttcaatcgaaaccatattcccgtctcagatcaattcaatgatgtctatttttctaacgaaaatggattagccgaaacagattatgtttttctacaaggtaatcaactttgggaacgttggataagccacaacgaggctaattttgtcattgctgaaacaggatttggtacaggattaaatttcttcgcggtaacccaattattccgtgaatttcgccagcaacacgagaatcatcctttaaaacgccttaattttatttcctttgaaaaatatccgctaaaaatcaccgcactttcgcaagcgcaccttgcctatccgcagtttgaagatttaagcgctcatttgcaacgttattggccttcattgattctaggttgtcatcgtattcattttggagagacaacgttagatttatggcttggtaatgtatcagaaaacttgccacaacttggtgattatatgaatgaacgtattgatgcttggtttttagatggttttgcgccgagcaaaaatcctgaaatgtggaatgatgatctctataaattaatgtttcgtttcacaaaacccaatggttcttttgccactttcaccgcagcaagtgcggttagaaaaggacttgaatccgcaggctttaatgtgacaaaacgtaaaggctttggcaaaaaacgggaatgtttaagtgggctaaaaatacaatcaaaatctaccgtactttccacaccttggtatcttgctcagcctgcgaaaatggaaaaacaagatgtcgctattatcggcggtggtatcgcttctttttgtgcagccatttccttagtaaaacgtggggcaaaagtcaccatttattgtgaagatgatgcgctcgctctcaatgcctcaggcaataaacaaggcgcattttatccgcaacttagcgatgataatgcgctcaccgttgatttttacctgcacgcttttagctacggtcgccaattacttgattgggcgatcgaacaaaacatagagtttgagcacgaattttgtggcgtggcactatgtgcttacaacgaaaaaagtgcggttaaattaacaaagatttctcaacttggtttaccgaacgaaatcttccaaatgctgagtgctgaacaactcagtgaaaaagtgggattaccgcttaattgcgaaggcggttggattgaacaaggggcttggcttgcaccaagacaatttgttcaaaatgccttttcatttcttgaaaagcaaggtgtaatcattaaaacctcacaaaaaattaccgcactttctcaacaagaaaaaggttgggaactagaaaatacgcaaggtcaaaaatactgccatgaagtcgtcattcttgcgaacggatataaaattactgattttgttcaaacagaaaagctaccgctctaccctatccgcgggcaagttagccaaattccaacatcagaaaacttactcaaactgaaatctgtgctttgttatgatggctatcttactccagccaatcaattaaaaacctcacattgcatcggcgcaagccatgttcgtgataatgttgatcgccactttagtgaacaagaacaacaagaaaaccaacaaaaactccaacaaaatatcgcccaaccttggactcaagatgtgaatacatcagataatctcgctcgtgtaggcatccgctgctctgtaagagatcttgccccaatggtgggaaacgtgcctcattttgaacagcaacaagcggattattacaatctatttaacctccgccgccgtaaacaacctatccaaagtgcggccaattttcagaatattttcttaatcgcagccttaggttctcgcgggcttacctctgctccactattaggcgaaaccttagcttcaatcatttatggcgagccattaccaataagcgaaggcatattacataatctttcagctaaccgagcttgggtaaaaaagtggttgaaaggttcaaaagttgaataa

SEQ ID NO: 2194 - DNA, 1221 bp, H. influenzae strain 86-028NP
atgagaagagctgtaattacaggctttgggattatttcaagtatcggtaacaacaaagaagaagtattggcttcattaaaagaagggaaatcaggtattgaagttgtgcctgagtttgtagaaatgaatatgcgtagccatgttgccggaacaatcaaattaaacccaagcgagcacattgatcgtaaagtgttccgttttatgggtgatgcagcggcttatgcttatctttctatgcgtgaagcgattgaagatgcaggcttaacagaagatcaagtttctaatgatcgtactggtttagtgattggtgcaggtacgggctctgcacataatcaattagtggcttgtgatgcggttcgtggccctcgcggtgtaaaagcgattggtccttacgctgtaacgaaaaccatggcatcaagtgtttcagcttgtttagcaacaccttataaaattcgtggtgtgaattattctatgagttctgcttgtgcaacctctgcacattgtattggtcatgcggttgaattaattcaattaggcaaacaagatatcgtttttgctggtggtgcagaagaattatcttgggaatgtgctactgagtttgatgcaatgggtgcagtttcaactaaatacaatgaaacgccagaaaaagcatctcgtgcttatgacgcaaatcgtgacggtttcgttattgcaggtggtggtgctgttgtggttgtggaagaattagaacacgcacttgctcgtggtgcaaaaatctacgcggaaattgtcggctatggcgcaacttctgacggttacgatatggttgcaccaagtggcgaaggtgcagagcgttgtatgaaacaggcaatggcaactgtagataccccaattgattacatcaacgtacacggtacatctacaccagttggtgacgtgaaagaattaggtgcaatcaaaaatgtatttggcgataaaatcccagcgatttcttcaactaaatcaatgacaggtcactctttaggggcggcgggtgcacacgaagcaatttacacgttgttaatgctggataatgattttattgcgccaagtattaatatcgaaaccttagatgaagccgctgaaggttgcaacatcgttactgagacgaaagaaaatgcaggattacaaactgtcatgtcaaatagctttggttttggtggtacaaatgcgacattaatttttaaacgttataacggttaa

SEQ ID NO: 2195 - DNA, 264 bp, H. influenzae strain 86-028NP
atgttcgttgttatttttggtcgtcctggctgcccttactgtgtgcgtgcaaaaaaccttgctgaaaaattaaaaggcgaagttgctgattttgactatcgttatgtggatattcatgcagaaggcattactaaagaagatttatcaaaatcagttggtaagccagtagaaaccgtaccacaaatctttattgatgaaaaaccaattggtggttgcactgactttgaagcattaatgaaagaacaatttggtatcgttgcttaa

SEQ ID NO: 2196 - DNA, 909 bp, H. influenzae strain 86-028NP
atgaaattattaatgctttgccgcgaacctcgtctttatagttgccaacgcttaaaagaagctgctaaacgtcaagggcatgagatggatattttagatccgaatcgttgcctcttaaaactctcacaaaatccaccgcactttcagattttttatcaagaaaattcagggtctaaaccttatttattgcctgattatgatgcagttttgcctcgatttggcacaacaagtacacaaatgggatgctcagtcttacagcattttgaaggcaaagggactttttgtttaaatttatctcaggcatttttaaatgcacgtgataagtggaaaagtttgcaacttttgctgaagactggtgttcctgttcccaattcatttttaagtggcggtgaagtgcaagctcaggcgacgatacctcatatcagttcgccgacaattttaaaaatgctaaatggttcacaaggaattggggtaattttagctgaaaagccacaaagtgcggtgagcattatggaagcttttaagcaaactaatatatctatgttgcagcaagattttattgaagaagcgggcaatgcggatattcgttgttttgtgattggtgatcaagttgtagcaacgatgcaacgaatcggacaagatggcgagtttcgagcgaattgtcatcgtggtggaaaaactgaaaaaattatactaagcgatgacgagaaacagatagccattagagcaacaaaagccatcggtttagatgtggctggtgtggatttaattcgttcaaaaaatggattattggttttagaagtaaatgcaagcccaggcttagaaatgattgaaaaaacaagtggggttgatattgcagctgaaataattgattatattgaaataaatgcctttatcaatttaagataa

SEQ ID NO: 2197 - DNA, 1215 bp, H. influenzae strain 86-028NP
atgagctatacttttagcacgtatgaaacccttgcattagcaagcttagttttgctattgggctattttttggttaaacgcattaatgtattaaaaacatttaacattccagagccagttgttggcggctttattgttgccattggtcttttaatttggcacaaaattgatggaacatcctttaacttcgataaaaatctacaaaccacaatgatgttagtgttttttacttctatcggtttaagtgccaacttttcccgtctaattaaaggcggaaagccactcgttgtatttctattcattgctgcattattaatcttcggacaaaacgttattggcattgcaagttcaatggcattaggaatccatcccgcttatggtttacttgcaggttcagtaaccttaacaggtggtcacggcactggagctgcttgggcggatacatttgcacatcaatttaatctacaaggtgcaactgaaattgccattgcctgtgcaactttcggtttagtattcggtggtatcatcggtggtcctgtcgctcgtttcttattaaatcgccaaaaacaaggcgaaaatcctgaaaatgatgaagttgatgacattcaagaagcatttgaacacccaacttataaacgtaaaattactgcacgttcattaattgaaacaattgcaatgatttcagtatgtttattaattggtcaatatttagatgtacaaacaaaaggtactgcactccaattaccaactttcgtatggtgtttattcactggtgttattgtccgcaatattttaagcaacattttccgtttccaagtagcagaatccgctattgacgtattaggtagcgtaggcttatccatctttttagcaattgctttaatgtcattaagactttgggaacttgcaggtttagcaattgatgtattaattgttcttgctattcaagtcgcatttatggctgcctttgcaatcttcattacttatcgagcaatgggtaaagattacgatgccgtcgtattaagtgctggacactgtggttttggtttaggcgcaaccccaacagcaatcgctaatatgcaagctgttaccagccgttttggaccatcacacaaagcatttttaatcgttccaatggtgggtgcattctttatcgacttaatcaacgcagcattattgaaagtctcatttgcagttgtaaatatgctcgcgtaa

SEQ ID NO: 2198 - DNA, 2244 bp, H. influenzae strain 86-028NP
atgacaaatatcaactatgaaggcattgagcaaatgcctctacgcaccttcactgaaaaggcttatctcaactattctatgtatgtcatcatggatcgtgcgttgccttttatcggtgatggtttaaaacccgttcaacgtcgtattgtatatgcgatgtctgaacttggcttaaatgccacggcaaaatacaaaaaatctgctcgtaccgtcggtgatgtacttggtaaattccatccacatggtgacagcgcttgttatgaagctatggtgttaatggcacaacccttctcttatcgttatccgcttgtagatggtcaaggtaactggggggcaccagatgatccaaaatccttcgctgccatgcgttatacggaatctcgcctatctaaaatctctgaaatcttgttgagtgaactcggacaaggaacagtagattatcaaccaaactttgatggaaccttggctgaaccacaatatttacctgctcgtttacctcatattttattgaacggcacaacaggtattgcggtggggatggccacagatattccaccacacaatattaacgaaattgctgatgcggcagtaatgttgctagataatcctaaagcgagattagatgatgtacttgaaattgttcaaggcccagattttccaacagaagcggaaattatttcgccaaaatcagaaattcgtaaaatttatgagcaaggtcgtggctcaataaaaatgcgtgcaacttggaaacaagaagacggtgaaattattatttctgcgcttccacatcaatcttcgccatccaaagttattgcacaaatagccgaacaaatgacggcaaaaaaactgccaatgctagaagatattcgagatgaagccgatcacgaaaatccaattcgcattgtgctagtccctcgctcaaatcgcgtcgatactgatgccttaatggcacatttatttgcgaccacagatcttgaaaaaaactaccgtgtaaatatgaatatgatcgggcttgatcataaaccagcggtaaaaggcttattagaaatcttaaatgaatggcttgacttccgtcgcacaacggtcactcgtcgccttcaatatcgcttagataaagtactctctcgcttgcatattttagaaggcttgatgatagcctttttaaatattgatgaagttatcgaaattatacgccacgaagatgatccaaaagcagagctgatggtacgctttaatttaagcgatgaacaagccgatgccattttaaatttacgcttacgtcatttagcgaaattagaagaaaaccaactcaaagcagaacaagatgaacttgaaaaagagcggttaaatttagaagcaattttaggatcagaacgccgtttgaatacgcttatcaaaaaagaaattcaagaagatgcgaaaaaatatgccagcccacgtatgtctcaactggtcgaacgtgaagaagccaaaatgatctctgaaagtgatatgacgccagcagaaccagttactgtcatcttatcagaaatgggctgggtacgttgtgcaaaaggacacgatattgatcctaaatcattaagctacaaagctggcgatagctatctagctcacgcttgtggcaaaagtaatcaagccgttgtattcattgatagcacggggcggagttatgcactcgatccgctttccttgccttccgctcgctcccaaggcgaaccacttacaggtaaactcaatttacccactggtgcgaccattgaatatgttgtaatggccagcgaacagcaagaattattgatggcttctgatgcaggatatggttttatttgtaaatttgaagatttaattgcacgtaacaaggctggaaaagccttgatttctttaccagaaaatgccaaagtgttgaagcctaaaacattgataaattctaccgcacttgttgtcgcaatcacatcagcaggcagaatgttgatttttccagcacaagatttaccggtattatcaaaaggtaaaggcaataaaatgatcactattcccgcagcgaatgcaaaagatcgtagcgaactattgacaaaattattgcttatttcagatcaagcaagtcttgaattttattctggaaaacgaaaaattgtattaaaaccagaagatctgcaaaagttccgcgcagaacgaggcagaaaaggttcgacattaccacgtggattacataccaatcttgaaattatggtagtcgagccgtaa

SEQ ID NO: 2199 - DNA, 1899 bp, H. influenzae strain 86-028NP
atgacaaccaattattcagctcaagaaattaccgttcttaaagatctcgaaccagtgcaaattcgcccgggaatgtacactgacactactcgccctaatcatttagcacaagaagttattgataacagcgtagatgaagcccttgccggttttgcctcaaaaattgaagtaattttacaccctgatcaatccattgaagtaacggacaatggtcgcggtatgcctgtggatactcatcctacggaaggcgtttctggcgtagaagtaatcctgactaaactgcatgctggtggtaaattctccaataaaaattatgaatttgcgggaggtttacacggtgtggggatttctgtggtaaatgcgctttctgaacgcgtggatattcaagtcaaacgcaatggcgaaatctataaaattgcctttgaaaacggcagtaaagtagaagaattggaaattatcgggacttgtggtagacgcacaacgggaacaaccgttcacttcaaaccgaatccaaaatattttgacagcgcaaaattttccgttagccgcctacgccatttattaagagcgaaagcggtactctgctcagggcttgaaatcaaattcattgataaagtaaacaatactcaagacatttggttatatgaagatgggctttccgattaccttatcgaagcagtaaatggctttgaaacccttccggaaaaaccatttgttggcgaatttaaaggaacaaatgaagcggttagctgggcattactttggttgccagaaggtggtgaactgattggcgaaagctacgtaaacttaattccaacaattcaaggcggaacgcatgttaatggtctacgtcaaggtttattagatgccattcgagaattttgcgaatttagaaatctattaccacgcggggtaaaacttaccgccgatgatatttgggatcgttgttcttacattctttcccttaaaatgcaggatgcgcaattcgcagggcaaacaaaggaacgcttatcatcacgccaaagtgcggtgtttgtcagcggtgttttaaaagatgcgttcagcctatggctaaatcaaaatgtacaagatgctgaaaaattagcagaaattgccattagttctgcacaacgccgattacgcgccgccaaaaaagtcgtgcgaaaaaaactcgttagtggcccagcattaccaggaaaattagctgattgtggctcacaggatttagaaaaaacggaattatttttagtggagggcgactctgctggcggctcagcaaaacaagcacgtgatcgcgaatatcaagcgattttgccgttacgtgggaaaatcttaaacacatgggaagtttcccctgatcaagtattaggttcaaccgaaattcacgatatcgccgtggctctagggatcgatcctgacagcaatgatttatcacaacttcgctatggtaaagtctgtattctcgcggatgctgactccgatggtctgcatattgccaccctactctgcgccctgttcttacgtcattttccgaaattggtacaagacggtcacgtttacgtcgcaatgccaccactttatcgcattgacttaaataaagaagtcttctacgcattagatgaaaatgaaaaagaggcgattttagatcggttgaaaaacaaaaaaggcaaaccgaatgttcaacgctttaaaggtttaggtgaaatgaacccatcgcaattgcgtgaaacaacaatggatcctaatacgcgccgtctcgttcaattaacttatgatttaggggaagatcaaggctcagatacattagaactgatggatatgttattagcgaaaaaacgttccgaagaccgtaaaaattggttacaagcgaaaggcgatcaggttgatttatctgtttag

SEQ ID NO: 2200 - DNA, 936 bp, H. influenzae strain 86-028NP
atgaaaaacgaaaaactccctcaatttcaaccgcactttttagccccaaaatactggcttttttggttaggcgtggcaatttggcgaagtattttatgtcttccctatcctattttgcgccatattggtcatggtctcggttggctgttttcacatttaaaagtgggtaaacgtcgagcagccattgcacgtcgtaatcttgaactttgttttcctgatatgtctgaaaacgaccgtgaggcgattttgcaagaaaatctccgctctgtaggcatggcaattatcgaaactggcatggcttggttttggtcggattcacgtatcaaaaaatggtcaaaagttgaaggcttacattatctaaaagaaaatcaaaaagatggaattgttctcgttggtgttcatttcttaacgctagaacttggcgcgcgcattcttggtttgcatcatcccggcattggcgtttatcgtccaaatgataatcctttgcttgattggctacaaacgcaaggtcgtttacgctctaataaagatatgcttgatcgtaaagatttacgcggaatgatcaaagctttacgccacgaagaaaccatttggtatgcgcctgatcacgattacggcagaaaaaatgccgtttttgttcccttttttgcggtacccgatgcttgcacaaccactggtagttattatttattgaaatcttcacaaaacagcaaagtgattccatttgcgccattacgcaataaagatggttcaggctataccgtgagtatttcagcgcctgttgattttacggatttacaagatgaaacggcgattgctgcgcgaatgaatcaaatcgtagaaaaggaaatcatgaaggggatatcacaatatatgtggctacatcgccgttttaaaacgcgccccgatgaaaagacgcctagtttatacgattaa

SEQ ID NO: 2201 - DNA, 1431 bp, H. influenzae strain 86-028NP
atggctcaatattcagcagaatttaagcaagcaaaagtacttgtattaggcgacgtgatgcttgatcgttattggttcggcgcaaccaaccgtatttcaccagaagcaccagtgccagtagttcgtgtacaagaaaatgaagaacgcgcgggtggtgcagcaaatgtggcgatgaatattgcttcactcaatgtatccgttcagttaatgggattgattggacaagatgaaactggttctgcactttccctcttattagaaaaacaaaaaattgattgtaattttgttgcattagaaacccatccaactattactaaattacgtattttatctcgtcaccaacagttactccgccttgattttgaagaagatttcaataatgtagattgcaaggatttattagcgaagttagaaagtgcggtgaaaaattacggtgctttgattctttctgattacggcaaaggcacgcttaaagatgttcagaaaatgattcaaattgcacgcaaagcgaatgtgcctgtgttgatcgatccaaagggaactgattttgaacgctatcgtggtgcgacattattgacacccaatatgtctgaatttgaagccgttgtgggtaaatgtaatacagaagaagaaattattaagaagggtttaaaattaatttctgatattgaattaaccgcacttttggtaacgcgttctgaaaaaggcatgacattattacgcccaaatcaagagccttatcatttgccaaccgttgcaaaagaagtgtttgatgtgacgggagccggtgacactgtcattagcgtattagcaaccgcattagcagatggacgttcttttgaggaatcttgttacctagccaatgtagccgctggaattgtggtgggtaaattggggacttcaacggtttcgaccgtggaacttgaaaatgcgattcatgctcgtcctgaaactggatttggcattatgagtgaagcagaattaaaagatgctgtcgcacaagctaaagcgcgcggtgaaaaaattgtgatgactaatggctgttttgatattttgcatccagggcatatttcttatttagaaaatgcacgcaaattgggcgatcgtctaattgttgcggtaaacagcgacgattctgttaaacgcttaaaaggcgaaagtcgtccaattaataatcttgaaaaccgtatggcggtattggctggtttggcatccgtggactggttggtgcctttcactgaagatacaccacaacgtttaatcggcgaaattctaccagatcttttagtcaaaggtggcgattacaaacccgaagagattgcaggcagtaaagaagtttgggcaaacggtggcgatgttaaagtgctaaactttgaaaatggttgttcaacaacaaatgtgattgaaaaaattaaattattgaaagattaa

SEQ ID NO: 2202 - DNA, 96 bp, H. influenzae strain 86-028NP
atgctcaacgaaaacgatatcgaacaactcactcttcaacgcctgcaatccctcggttgggaatatcgctacggtaaagatttgcctgttcattag

SEQ ID NO: 2203 - DNA, 357 bp, H. influenzae strain 86-028NP
ttgcattatattgcagaaattagaaacgaatgtggtagttatgcttctcacggtcaagatatagaacacaaacaaataagtagtgatcttgctttatttgtacttcattcaaccaatgcaattttaggatttattctacacttttacattgctacaaatgattaccgtagaagtgaaaggatacaatatgaagataatcaaagaatcaacgaattaattgatgaggcgtatgaaatggaaacaatatataaaatttcatattcacaagcattatttgctcaagatcctgatacctatagagaaatggtattggagtttgagcaaatagaatatgaacggttgatggacacgctctaa

SEQ ID NO: 2204 - DNA, 405 bp, H. influenzae strain 86-028NP
ttggatgtggaagttattgaatggctggaaaatttcttactggatttccaaggtagcattgtatttatttcccatgaccgttcttttattcgcaaaatggcaacacgcattgtggatttagatcgcggtcaattgcagtcttatctaggcaattacgatttatatttaaccacgaaagaagaaaatctacgcgttgaagccttgcaaaatgaattatttgataaacgtcttgcacaggaagaagtgtggattcgccaaggtatcaaggctcgccgtacaagaaatgaagggcgagtgcgagcattaaaagcgatgcgtgaggaacgtcagttaaagccttatcggggggagaacgaaatcgtttattactcgcaaaattgttgctcaaaccaaataatttattga

SEQ ID NO: 2205 - DNA, 561 bp, H. influenzae strain 86-028NP
ttgattcttgacgaaccgaccaatgaccttgatgtagaaacattggagcttttagaagaaattttgactgattatcaaggcacattgttaattgtgagccacgaccgtcaatttatcgataatactgccacagaatgttatttattcgaaggtgaagggcatttgaataagtatgtgggaggattctttgatgcgaaacagcaacaagccaatttctgggcaagtaaagcagtggaagagcaggctaaagcgaagaaaactgaaccgctaaaagaagaaagtgcggtgaaaaatgaccgcacttctaagccgaaatccgtgaaactttcttataaagaacaacgtgagttagaacagctgccacaactattggaagagttggaaactaaaatcaccgtacttcaagctgaaatagccgatccagcatttttccaacaggctcacgatattaccgacgctaaattaaaagcattggcggatactgaagccgaattagaaacagcatttttacgctgggaagaattagaagaaaagaaaaatttggctgacggtaaagcttaa

SEQ ID NO: 2206 - DNA, 690 bp, H. influenzae strain 86-028NP
atggataaaattaaacaactctttgccaacaattacagttgggcacaaagaatgaaagaagaaaattctacttacttcaaagaacttgcggatcatcaaacgccacattacctttggattggttgctctgatagccgtgtacccgctgagaaattgacgaatcttgaaccaggtgagctttttgtacatcgtaatgttgctaaccaagtaattcacacagattttaattgcctttctgttgtgcaatatgccgtcgatgtgcttaaaattgaacatattattatctgtggtcacaccaactgcgggggaattcacgctgctatggcagataaagatttagggcttatcaacaactggcttcttcatattcgtgatatttggtttaaacacggtcatcttctcggtaaactttctccagaaaaacgtgccgatatgctaactaaaattaacgtagcggaacaggtttacaatctagggcgcacatcaattgtaaaaagtgcttgggaacgcggacaaaaactctcattacacggctgggtatatgatgtaaatgatggatttttagtggatcaaggcgtaatggcaaccagcagagaaacccttgaaatttcttatcgaaacgctatcgctcgtttatcaatacttgatgaagaaaatattttgaaaaaagatcatcttgaaaatacataa

SEQ ID NO: 2207 - DNA, 1509 bp, H. influenzae strain 86-028NP
ttgttcatagcccgcaccaacactatatttttatggaaaatttcctttattaaggtaaactgtcggcaattttatgtgaattacattcagttacagaggtttaatatgtctaaagtggcatcaattgttgatgtattacaagggaaagtggcgattggtgaaaccgtcactgtgcgtggttgggttcgtacccgtcgcgattctaaagcaggcttatctttcttagcggtttatgacggttcttgctttgatccaattcaagcaattattaataacgatattaaaaattacgaaagcgaaattttacgtttaacaacaggctgttctgtgattgtaactggtaaagtcgttgaatcaccttctgaaggacaagcggttgaattacaagcagaaaaagtggaagtgacagggtttgttgaagatccagatacttacccaatggcagcaaaacgccactctatcgaatatttacgcgaagtagctcacttacgccctcgtaccaatattattggcgcggtcgcgcgtgttcgtcattgcttgtctcaagcaattcaccgtttcttccatgagcaaggtttctactgggtggcaaccccattaattactgcatcagacactgaaggtgcgggtgaaatgttccgtgtttctacacttgatttagaaaatcttccacgtagtgaaaatggaaaagtggatttcagccaagatttcttcggtaaagaatcatttttaacggtttcaggtcagttaaacggcgaaacctatgcttgtgcattaagcaaaatttatacttttggcccaacattccgtgcagaaaactcgaatactacccgtcacttagctgaattctggatggttgaacctgaagttgcatttgcaaccttagcggataacgcaaaacttgcagaagatatgttgaaatacgtatttcgtgcagtattagcagagcgtaaagacgacttacaattctttgaaaaacatgtagataaagatgttattactcgtttagaaaactttgtaaactcagattttgcgcaaattgactataccgatgccattgatgtgttattaaaatctggtaagaaatttgaattccctgtttcttggggcattgatctttcttctgaacacgaacgtttcttagcggaagaatatttcaaatcaccagttgtggtgaaaaactatccaaaagacattaaagcattctatatgcgtttaaatgatgatggaaaaactgtggcggcaatggacgtgttagctccaggaattggtgaaatcatcggtggttcacaacgtgaagaacgtttagaggtgcttgataaacgcatggaagaaatgggattaaatccagatgattattggtggtatcgcgatcttcgtaaatacggcagtgttccacattctggttttggtcttggttttgaacgtttaatcgtctatgtaactggcgttcaaaatattcgtgatgtaattccattcccacgcgcgccaagaaatgcgaatttctaa

SEQ ID NO: 2208 - DNA, 474 bp, H. influenzae strain 86-028NP
atgaaagttttagaaggctcagttgcagcacctaatgcaaaagttgcagtagcaattgctcgttttaacagttttattaatgaaagtttattagaaggcgcaattgatgcattaaaacgtatcggccaagtgaaagatgaaaatatcactatcgtgcgtaccccaggcgcgtatgagttgccattagttgctcgtcgtttagctgaaagtaaaaaatttgatgcgattgtggcattaggtacagttatccgtggtggtacagcacattttgaatatgtagcaggggaagcaagcagcggtttaggaaaagttgcaatggatgctgaaatccctgtcgcttttggtgtattaactacagaaaatattgaacaggcgattgaacgtgctggtactaaagcaggaaataaaggtgcagaagcagccttaaccgcacttgaaatggttaatcttattcaacaaattgatgcggcataa

SEQ ID NO: 2209 - DNA, 435 bp, H. influenzae strain 86-028NP
atgacagaacaaaaacaagtgaaaaagccttctgctcgtcgtcgtgcgcgtgagtgtactgttcaagccttgtattcttgggcagtatccggcaatactgcagaacaagtggaattagcctttgtgttagatcaagatatggatggggtagataaaccttacttccgtaaattatttcgtcaaacagtagaaaatattgaaaccgttgatttttcaatttcgccttatattgaccgcgcttttgatgagcttgatcctattgaaacggcaattttacgtttggccgtttatgaattgtgcttcgagttagatgtgccatataaagtggttatcaatgaagcgattgaagtggcaaaagtattcggtgcagatgaaagccataaatatatcaatggcgtacttgataaaatcgcaccagcattagggcgtaaataa

SEQ ID NO: 2210 - DNA, 987 bp, H. influenzae strain 86-028NP
atggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaggcactttaggcgatagcgcggcaggtttaacacaaattttattgggcaaaagtgcggttgattctgatgatgtttttttgcaacaacgacatcttagacccacacctagaattgaacttgggcgggcgttaattgatattgctcatgctgccattgatctttccgatgggctaatatctgatttagggcatattcttgaacgaagtcaatgtagtgctgaagttgaactgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataattttttcaagcggtttcgatcattttaaggaatcaaaatga

SEQ ID NO: 2211 - DNA, 492 bp, H. influenzae strain 86-028NP
atgacagaaaataatcctcttaaaaaaatctctcttttaaatcctattcatttgcttgccgttggttttggctcgggtttaatttatccagcacccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtga

SEQ ID NO: 2212 - DNA, 630 bp, H. influenzae strain 86-028NP
atgctaaatttaatcattgtgcatttatttggattaatgacgccagggcctgatttcttttatgtaagtcgaatggcggcaagtaactctcgtcgtaatacagtttgtggcattttaggcataacgcttggtatcgctttttggggaatgctttctatgttgggattggcggtgttgttcgttaccattccagcattacatggcgttattatgttgctaggcggtagttacttagcatatctcggttttttaatggctcgcagcaaaaaatacgctcaatttgaaccgcactctgatactgaatttaatcagcaaaccacaatcaaaaaagaaattttgaaagggcttttagtgaatttatccaatgcaaaagtcgtggtgtattttagtagcgtgatgtcgcttgtcttagtaaatatcactgaaatgtggcaaattatcttggcttttatggtgattgtggtagaaacattttgttatttttatgtgatttcattgattttttcacgtaatattgccaagcgtttatacagtcaatacagccgttatattgataatatggcaggtattgtatttttattttttggttgtgcgcttgtttataacggcatcaacgaaataattcattaa

SEQ ID NO: 2213 - DNA, 813 bp, H. influenzae strain 86-028NP
atgacattaaaaattgcaatcgctggtgctggcggaagaatggggcgtcaattaattcaagcggttcattctgcggaaggcgtagaactaggtgcggcttttgaacgcaaaggatcatctttagttgggacggatgcgggagaattggcaggaattggtcatcttggcgttgcagtttcagacgatcttgaaagccaaaaagataaattcgatttattaatcgattttacccgaccagaaggctcccttgaacatattgcattttgcgtagcgaataataaaaaaatggtgatcggtacaacgggttttgatcaaaatggtaaagcagcgattaaagcagcttcagataaaattgctattgtgtttgcatcaaatttcagtgttggcgtgaatttagtcttcaagcttttagaaaaagcagcaaaagtgatgggggattattgcgatattgaagtgatcgaagctcatcaccgtcataaagttgatgcgccatctggcactgcactttctatgggcgaacatatcgcaaaaaccttaggtcgcgatttaaaaacgcacggagtcttctgccgtgaaggaattacaggcgaacgtaaacgggatgaaattggtttttcaactattcgcgcttcggatgtggtgggggaacacacggtttggttcgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataa

SEQ ID NO: 2214 - DNA, 249 bp, H. influenzae strain 86-028NP
atgaaaatccaccttatccgccataacaccacattagaattcaataatgaaacaagtttacttgatcatctcgagaaaaataatattcatcacgaatatcaatgccgtagtggctattgtggttcttgtcgcgttaagatcaaaaaaggcaaggtgtcttataaagaaatgcctcttgcctttattcaacctgatgagattttattatgttgctgtcacgtagaaagtgaccttgaaattgatttataa

SEQ ID NO: 2215 - DNA, 741 bp, H. influenzae strain 86-028NP
atgaaattattgataaaaacttcacttagtcagtggatttgcttgaattttgccaaaattcctatttttaaaatgctaggttttataaccgcactttttattacggcttgtagttctattagcaaagaaccagtgaagactgtggatatttatattaaaccttattattctgctgaaaatggaaaagcagaaaatgtatttgtacataaagaaattgatcctatgttacgtgaaaatacgctaaaaggttataaaagtacggtaaaatttttagaagaaaatccagctcgcatttcaccaatgacaatgtttaccttagccgctcgggcttacgattttggcttaagagatgaagcggttacttggttttatcgtggtcaaaatcgtttgatcaccgcactttatgtgttggatttaccaaaacaaacggtgcaggataatacagggttcagccatgttgtagggcagtttgttaatgcttatgcgttttgtgattttgataaacaaagtcgtgctgccgaaaatgcggtgaaatggacaattgcgcatccttatgaagtggttttcttaccagcattacccgcaaaatttgcagatcgtcaaaaagcgttaaaagaatcggaagaaaaattagttcaacgtttacaggaacaagcccgtttttttgctaatccaaaaaataaagaaaaatggcaaaaaaagcggtcagaaaattttgtgaatgaacgattttgttggtaa

SEQ ID NO: 2216 - DNA, 990 bp, H. influenzae strain 86-028NP
atgcaacatctgaacgagcttgttgagaaagcgaaattagcgattgaatccattcaggataaaagtttaacggctttggatgaaatccgtgtcgaatattttggtaagaaagggtattttacgcaattaatgcaagaattgcgtaacgtgtcagcagaagaacgtcctgcgatgggcgcaaaaattaacgaagcaaaacaagctgcgttagaatttttaaatgcaaaaaaaacggagtgggaacaggctgaacttaacgcaaaattagaaaaagaacgtgtagatgtcagtttaccaggtcgcaaagttgaaactggtggcttacacccagttaccatgacgattaatcgtgtaacaaaatttttctcagaacttggcttttcagttgaaaatggccctgaaattgaaagtgattattacaactttgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcaccgaattgaaaggtttattgcacgatttcttacgcgctttctttgaagaagatttacaagtgcgtttccgtccatcttatttcccattcacagagccttcagcggaagtggatgtgatgggtaaaaatggtaaatggttagaagtgttgggctgcggtatggtgcatccaaatgtgttgcgtaacgttggtattgatccgaatgaatattctggttttgccgtgggaatgggtgttgagcgtttaacaatgttacgttataacgtaacagatttacgttcgttctttgaaaacgacttacgtttcttaaaacaatttaagtaa

SEQ ID NO: 2217 - DNA, 2388 bp, H. influenzae strain 86-028NP
atgaaatttagtgaacagtgggtaagagaatgggtgaaccctgcggtgtccaccgagcaattatgcgagcaaattaccatgcttggcttagaagtagatggcgtggaaagcgttgcgggtacatttaatggtgtcgttgttggtgaagtagtggaatgtgcacaacatccagatgcagataaattacgtgtaactaaagtgaacgtaggcggtgatcgtttattggatatcgtgtgtggcgcagcaaattgtcgtcaaggcttaaaagtggcttgtgcaacagaaggtgcggtattacctggcgatttcaaaattaagaaaacgaaattacgtggtcagccatcagaagggatgctttgttcattttctgaattaggtattgatgttgaagcggatggtattattgaattgccacttgatgcaccaattggtactgatttacgtgaatatttagctttagatgataatgccatcgaaattagcttaacgccaaaccgtgcagattgtttgagcatcgcaggtattgcgcgtgaaattggtgtggtaaataaacaactcgtaaatcaaccgcactttgaagcagtgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgctgtggtattcgttctatcgatcctattgtcgatattactaactatattttgcttgagttcggtcagccaatgcacgcgtttgatgcagctaaagttacacaacctgttcaagttcgtttcgcgaaagagggggaagaattagtattattagatggctcaaccgcaaaacttcaatcaaatacgttattaattgctgaccaaaatgggcctttagcaatggcagggatctttggtggtgcaaccagtggcgtgaatagtgaaacgaaagatgtgattttagaatccgcatttttcgctccattagcgattgcaggccgtgcaagacaatatggtttacatactgatgcatcgcaccgttttgaacgtggtgtggattttgaattagcccgtaaagcaatggaacgagcaaccacattattacttgaaatctgtggtggtgaagcgggtgagatttgtgaagcaagcagtgaaactcatcttcctaaagtcaatacagttcaacttcgccgtagtaaattagatgcacttttaggtcatcatattgaaacaggaagcgtaacggaaattttccaccgtcttggtttcgatgttacttatgcaaatgatatttggacggtaacttctgcaagctggcgttttgatattgaaatcgaagaagatttaattgaagaagtggcgcgtatttatggttataacagcattccaaacaatgcgccattagcgcatctccgcatgcgtgagcacaaagaatctgatttagatttagctcgaattaagaccgcacttgtggatgcagattatcaagaagctattacttatagctttgtggatccaaaaattcaaagtttattacatccacataaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtaatagagttcgttttgttgcaaaacaatttgatgcattacaccctggccaatctgctgctattgaattagatggtcaagaaattggttttattggtgcaattcatccatctattagtcaaaaacttggcttaaatggcaaaacgtttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaa

SEQ ID NO: 2218 - DNA, 291 bp, H. influenzae strain 86-028NP; identical to SEQ ID NO: 744

SEQ ID NO: 2219 - DNA, 486 bp, H. influenzae strain 86-028NP
atgaaagtatataaatcatttttaatcgctactgcctcgctgtttttattcgcttgttccagttttcaaaacgatgattatgcgatgaactataaaggtcaaatcggcgatcctattatggccatagccatgttgagcgaacaacaacatgaatgggctggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaacatattcaaactggcgatttaattttctttaaaactggccgaggtcctaatggttatcatgtggggatttatgtaaaagaagataaattccttcatgcttccaccagagggggagtcgtctattcttcaatgaataacccttattggtcgaaagccttctggcaagtcagacggatttaa

SEQ ID NO: 2220 - DNA, 1011 bp, H. influenzae strain 86-028NP
atgctggaattttccagcattttttataatgatttttttcaaattagggagataaaaatgccctcaaacttaaccgcacttcaaattcaacttgaaattttacgccttattccaaaaactcgttttattaccgcagaagaaatcttacaaaaacttgctgatattggtgttcaacgtgatattcgttcaatccaacgcctgctagaaagtttgtctcaacagtttgaaattgagcgagatatgcgtgataaaccttatggatatcgatggaaatcaaatgctaaaggcttggatttaccgattttaaatgaacagcaatcacttgtgcttatgcttgctaaacaatatctcaatggcattttgccttctagcattatgaactcaatggaggcgttctttcaacaggccgaatataatttggtttatgacagccataaaaaatcaggggcagaatggcttaataaagttgctattgcaccaactagtcagccgttattacctgccaaaatcaatccagaaattttttctcaaattagtaccgcactttatcaaaatcgatttttacaggtgcattatcggagtattcacggtaaagaacataaggcacaggtcaagccattggctttggttcaacaaggaccaagtagctatttagtcgcacaatatgagaatggcgatattttacaccttgctttgcatcgcttgcttaaggtaacagtgagtacaatgatatttgaacgccctgattttaatttgaaatcttatgtagaaagccaaaagtttggttttacctatggtcgaaaaattcgattaactttccgcattaataaagatattggtggatttttaacagaaacaccattatcaatggatcaaacagtaaaagattgtggcactgaatatgaaatttccgctaccgtgattaagagcgctatgctggaatggtggatagcccattttggtgaagattaccaagaaattgaccgcacttatttagacgaaaatgcctaa

SEQ ID NO: 2221 - DNA, 456 bp, H. influenzae strain 86-028NP
atgaagaaaattgtttatattgatatggataatgtgatggtagattttccatcaggtattgcaaaactagatgataaaaccaagcgagaatatgaaggtcgatatgatgaagtcgagggcatttttagcttaatggaacctatgccgaatgcgatttctgcggtgcataaattgatgaaaaaatatcatatttatgtgctttctactgcgccttggcataatccttctgcttggagtgataaagtaaaatggattcaacattatttcggtgaagaaaaaggttcagccttatataaacgattgattttatcccatcataaaaatctcaaccaaggtgattatttaattgatgatcgcactaaaaatggtgctggcaaatttcaaggcgagcatgttcattttggtacagaacagtttgctaataaaaggagcctgaaaaatgacagagaaaaataa

SEQ ID NO: 2222 - DNA, 711 bp, H. influenzae strain 86-028NP
atgacagagaaaaataaaccaatttgcgtggtattaacgggagctggcattagtgccgaaagtggaattccaacttttagatcggaagatggtttgtgggcagggcataaagtagaagaagtttgtacgcccgaagccttgcaaaagaaccgtgcgaaagtgcttgatttctataaccaacgccgtaaaaatgcggcagcagctaagccaaacgctgcgcatctcgccttagttgaactagaaaaagcctatgatgtgagaatcatcacgcaaaatgtggatgatttacatgaacgtgccggcagctcgaaggtgttgcatttacacggtgaattaaataaagctcgcagtagctttgatgaaagttatattgtggattgttttggtgatcagaaattagaagataaagatccaaatggacacccaatgcgcccttacatcgtcttttttggtgaaatggtgccgatgctagaacgagcggttgatattgtggaacaagcagatgttgtgttagtgattggcacttctttacaagtgtatccagccaatggcttagtcaatgaagccccaagaaaagcgccaatttatctgattgatcctaacccaaatacaggatttgttcgtaagcaagttattgcaatcaaagaaaaagcaggcgagggtgtgccaaaagtggtggcagagttattagagaacaccaaaaactcatag

SEQ ID NO: 2223 - DNA, 1023 bp, H. influenzae strain 86-028NP
atgttagttattaaggaaaataatatgaataaccaaaacccgattgaaatttaccaaactcaagatggcacaacgcaagtggaagtgagatttgaaaatgacaccgtttggctttcccaagcgcagatggctatgttatttggtaaagatattcgcaccatcaatgagcacattaccaatatatttgatgacgaagaacttgagaaagaatcaactatccggaaattccggatagttcgccaagaaggtaaacgccaagtcaatcgtgaaattgagcattatgatttagatatgattatctctgttggctatagagtaaaatctaaacaaggcattagtttccgccgttgggcaactgcacgtttaaaagaatatctgactcaaggctataccattaaccaaaaacgtttacagcaaaatgctcacgaattagaacaagcacttgcgcttattcaaaaaacggcaaattcatcggaattaacgctagaaagcggtcgcggattagtggatattgtcagccgttatacgcatacgtttttatggctacaacaatatgatgaaggtttacttgccgaaccacaaacacagcaaggcggtacattaccgacttatgctgaggctttttctgcactagcagagttaaaatcacagctgatgacaaaaggtgaagcaagtgatctctttggacgtgaacgagataacggcttatctgcgattctaggtaatttagatcaaagtgtatttggtgaacctgcttatccaagcattgaagcaaaagcggcgcatttactttattttgtcgtcaagaatcatcctttttcagatggtaataaacgtagcggcgcatttttatttgtagatttcttacatagaaatgggcgtttgtttgatcataatggatacccagttatcaatgatactgggcttgccgcgctcactttattagttgctgaatctgatccgaaacaaaaagaaacgcttattaggcttattatgcatatgcttaagcaagagaaaaaatga

SEQ ID NO: 2224 - DNA, 201 bp, H. influenzae strain 86-028NP
atggcaatgaaagtaattatggcaagagatccactttttgaggatgtaaaaaaatatgtgcaacaacaaaaatttgcatcttgctcaatgattcaacgcagatttatgttgggttttaatcgagctgggcaaattttagaacagttggaacaagcgggtattatttcatcaatgaaaaatgggcagagaaaagtattatga

SEQ ID NO: 2225 - DNA, 846 bp, H. influenzae strain 86-028NP
atgaaaaatgatttgaattatgcagtggaacttatccgcaaagcggatggcattttaattacagctggtgcgggtatgagcgtggattctgggcttcccgatttccgcagcgttggcggattttggaatgcttatcctatgtttaaagaacataatatatcttttgaagagatcgcaacgccactagcttataagcataatcaggaactagcctattggttttatgggcatcgattagttcaataccgaaatactcttcctcacgaagggtatcagattttaaaatgctgggcgggagataaacctcatggatattttgtttttaccagtaatgttgatgggcattttcaaaaggctggttttaatgatagccatgtttatgaagtacatggtactttggagcgtcttcaatgtgtcaataattgtcgaggattaagttggtctgcatcaagttttcaacctgtcgtggataatgaaaacttatgtttaaccagtgaaaaaccacattgtccttattgtgggggctttgctcgtcaaaatgtactaatgtttaatgattggagttatgcaagtcaatatcaggattttaaaaaagtgcggttagaatcgtggttaaaagaagtgcaaaatctcgtcgttatcgaactgggagcaggaaaagccattccaactgtgcgtcgattttctgaacgtacggcgaaagcaaaaaaagggggggttatccgtattaacccacaagatgcaggcgtgccgaaaatgcactttttaagtctagaaatgaaagcgttagatgcactaaaagcgattgatcgccttctaaatccttctcaacaagcggttgaataa

SEQ ID NO: 2226 - DNA, 762 bp, H. influenzae strain 86-028NP
atggaaaatttttgcgaaattaccttttgccaacaaattggcagcaacaagcgacgcaaccaagatgccctttttaatggcgaggcggtgtttcaatataaactcaaaacggctgaaaaacgccttgaaaaccgaccgcactttattgtgggcgtggcagatggtatttctaatagcaaccgacctgaaaaagcgagcaaattggctatgcaattattaagccaaatggaaagtataaaccgtcaaacgatctacgatttacaatccagtttatcagcagaattagctgaggattattttggttcggcgaccacatttgtggctgccgaaattgatcaaataacccgtaaagcgaaaattctcagcgtaggcgatagtcgtgcttatttaattgatgcccaaggaaaatggcaacaaatcacccaagatcattctattctttctgaattattgactgatttccccgataaaaaagaagaagattttgccaagatttatggcggcgtttcttcttgtttagtcgccgattattccgaatttcaagataaaattttttatcaagaaattgaaattcagcaaggggaaagtttattactttgttctgacggcttgaccgacgggctttcagatgaaatgcgcgaaaaaatttggcagaaatatcccgatgataaatatcgccttacggtttgccgcaagatgattgagaagcaatcgttttcggatgatttgtcggtagtttgttgtcattctattattgagtaa

SEQ ID NO: 2227 - DNA, 975 bp, H. influenzae strain 86-028NP
atgtttgaaaaaattgaacctactaatattcgttttattaaattaggcataaaaggatgttgggaaaaagattgtattgataaaaatagtacagcaagtacaaaaaatacgattcgtcttggctatgaatctacatcagagattcacaaagaatgtttgaataatcaatgggatagttgtattgaatattgtaaaacttattggagtgaccatacaggaactgtttcaaatcacttgagacaaattcaagatttttatcaacttggggaagatacactttggatcaccttctttggacgtaaattatattgggctttttgcagtaaagaggttgttgaggaaagcgatggttctagaacaagaaaagttattagtaacaatgggaattggtcttgcgttgatgctaacggtaaagagcttttagtcgataatcttgatggtagagtaacaaaggtccaagcctatagagggacgatttgtggtgttgagatggaggactatttaatacgtcgtataaatggtgaagttattgaggaaattacagaagcgaaagaggcgtatgaaacattaattaaatcagttgaaaaattaattaaaggtttatggtggagtgactttgaacttttaacggatcttgttttttctaaattaggatggcaacgatactctgttttaggtaaaacggagaaaggaatagatcttgatttgtattcgtcttcaacgcagaagagagtatttgtgcaaattaagtcagatacggatattaaacaattagacgaatatgtttcgaactttgaaagtgaatataaaaactatggttattcagaaatgtattacgtatatcattctggtttagaaaacatagatgaaaaacaatatcaagctaaaggaattaagcttgtaaatggccgaaaaatggcagagcttgtaattagtgctggtttagttgaatggttgattaacaaacgttcttaa

SEQ ID NO: 2228 - DNA, 168 bp, H. influenzae strain 86-028NP
atgtctgaatataaattaaacccaccgacagtgtcttcttatactgaaaatatgatgcttaaagttttatttgagcataaaggtttttccgaagtgtttcgggagactagctggcgaagtgatgaaattgccagtgcatttgggctgcctgaagaattgagagaatga

SEQ ID NO: 2229 - DNA, 1716 bp, H. influenzae strain 86-028NP
atgcatttacgtagtgaaggagctatgcgagatttgtttggctacttgccgaaatcggatttacaaagaacggctgcgatcatggcggatttacttaaacagccgaaaaatcagattctatctgccttaaagaaaggcagtaaactcgatgcttatggcctgattgatcgcgattatcgccccgatagtgtgcatgattatttagattggggcgaaaccttagattttgatgaatttgtgacacaaccattaaacgaaaacgtcctattaaaatcttgtacggaagtcgctcaagtgccaagtctgcaactggatgattttgaccatattgccggcatgaaagagatgatgttgacttatttgcaacaagcactaaaacatcatcgaaaaggcgtgaatcttttaatttatggcgtgcctggcactggtaaaacagaattcgccgggttgcttgcacaggcgttggggatttcggcgtataacattacttacatggattctgacggagatgttgtggaggcagagcaacgcctgaactacagtcgtcttgctcaaacgctattgaacggcaagcaggcgcttttaatttttgatgaaattgaagatgtgtttaacggctcgtttatggagcgttctgttgcacaaaaaaataaagcgtggacaaatcagttattggaaaacaataacgtgccgatgatttggttatctaactctgtttcgggcatagatcctgcttttttacgccgctttgattttattttagaaatgccagatttgccgttgaaaaataagtcagcactgattacgcaactgactgagggaaaattaagtccggcctatgtgcagcattttgctaaagtgcggtcattaacgccggcgattttaagccgcacaattcgggtggcaaaggaactcaatacatcaaattttgctgagactttgctcatgatgtttaatcaaacgttaaaatcgcaaaataaaccgaaaattgaaccgcttgttttaggcaaagccgactacaacttggattatgtggcttgtaacgacaatattcatcgtattagtgaagggttaaaacggtcgaaaaaagggcgaatttgttgctatggcccgccgggaacaggaaaaactgcttgggcagcgtggcttgcggaacagttggacatgccgctattgctaagacaaggctcagatttacttaatccttatgtgggcgggacagaacaaaatattgctcaagcctttgaacaagcgaaagccgataatgcaatattggtgctagatgaagtagatacgttcttattttctagagaaggcgcaaatcgaagctgggagcgttcgcaagtgaatgaaatgctaacacaaattgaacgctttgagggcctgatggtggtatcaacaaatttaattgaggttcttgatcacgcagctttacgccgttttgatttaaaattgaagtttgattatttaacgctcaaacaacgcttagattttgctaaacaacaagcagaaattttaggattgccgttgttatcggaagaggatttaagtcagattgaatcgcttaatctgctgacaccaggggattttgctgcagtggctcgtcgtcaccaattttccccttttcacaaggtgcaagattggctgatggcactacaaggggaatgtgaagtgaaaccagcgttttctgcaacgacaaggcggatagggttctaa

SEQ ID NO: 2230 - DNA, 438 bp, H. influenzae strain 86-028NP
atgattatcaaagatccaaactctgatcgtgtaaatcaagaagatgataaccttgtttatcttcacgacttaacttcaacagtctttgatttagccaatcaaaaagtgccagaaagttttgaagggcagagcattcttccgattatgcgccaacaccaagataaccaacgaaaaggtgtacttggtcagcttgcggggcattttgtgtattttgaacagcgtatgtggcgtcgtaaagattacaaactcgtatttaatgcgactgatgtttgcgaactttacaacatccgtaacgatccagaagaaatgcacaatttgttttatgatcctcaatataacagaatcaaaaaagagatgttggaagaaattcgtgcagagatgaaacgtctgaatgacccactggaaaattgggtttatcgaattattgacgaaatttaa

SEQ ID NO: 2231 - DNA, 813 bp, H. influenzae strain 86-028NP
atgaaaacaacattactaaaaacactgacaccagaacttcatcttgttcaacataatgatattcccattctttatctaaaacacgctgttggaacagcaaaaatttccctgcaaggggcacagcttatcagttggaaaccgcaaaatgcgaagcaagatgtattatggctaagtgaagtagagccattcaaaaatggcaatgctattcgtggtggtgtaccgatttgctatccttggtttggtggcgtaaaacaacctgcgcacggcacagctcgtattcgtttatggcagttaagccattatgatatttcagcccataaagtgcggttagaatttgagttgttttctgatttaaatattatcgaagcgaaaattgctatggtatttacagacaaatgtcatttaacttttacccattatggcgaagaatcagcccaagcagcattacatacctattttaatattggggatattaatcaagtggaagtacaaggtttacctgaaacttgttttaatagcttaaaccaacaacaagaaaatgttccgtcaccgcgtcacatttctgaaaatgttgattgcgtttattccgcagaaaacatgcagaatcaaatcctagataaaagtttcaatcgtacaattgcactgcatcatcataatgcaagtcaatttgtcctttggaatccttggcacaaaaagacgagtggaatgagtgaaactggctatcaaacgatgttgtgcttagaaactgcacgcattcatcacttacttgaatttggcgaaagtttaagcgtggaaatttcgcttaaaggctaa

SEQ ID NO: 2232 - DNA, 408 bp, H. influenzae strain 86-028NP
atggcagaacaagcagagcttgatcttgttgaaattagcccaaatgcagagccgccggtttgtcgcattatgaactacggtaaattcctttacgaaaaaagtaaaaccgctaaagaacaaaagaaaaaacaaaaagttgtgcaagttaaggaaattaaattccgccctggcacagacgaaggtgactatcaagttaaattacgcagcttaatccgtttcttagaagacggtgacaaagcgaaaattaccgtgcgtttccgcggtcgtgaaatggctcatcaagacatcggtttagatgtattagagcgcgtaaaaaatgatttagctgaaatttcagtggttgaatctgcaccaggtaaattagaaggccgtcaggctgtaatggtgttagcaccgaagaaaaaataa

SEQ ID NO: 2233 - DNA, 270 bp, H. influenzae strain 86-028NP
gtgcttccaagtaactttataagttcgcctgattatgttgttttaaacgaaaaatgcggagttattttaacaatgcctaaaatcaaaacagtacgcggcgcagcgaagcgcttcaaaaaaactgcttctggtggtttcaagcgtaaacaatctcacttacgtcatattttgactaaaaaaacaactaaacgtaaacgtcatttacgtcataaatcaatggttgcgaaagcagaccaagttttagtagtagcttgcttaccatacgcataa

SEQ ID NO: 2234 - DNA, 354 bp, H. influenzae strain 86-028NP
atggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcatatcgtgaccgtcgtcaacgtaaacgtcaattccgtcaattatggattgcacgtatcaacgctgcagcgcgtcaaaacggtttatcttacagcaaattcatcaacggcttgaaaaaagcatctgttgaaatcgaccgtaagattcttgctgatatcgctgtattcgacaaagtagcgtttgctgcattagttgaaaaagcaaaatctgcactttaa

SEQ ID NO: 2235 - DNA, 3636 bp, H. influenzae strain 86-028NP
atggccgaaacaatcccactgaatcccatcacgctacctttaaatcaaattagcttaatcgaagcatctgctggtacgggaaaaacctacactattggttctttatatctccgacttttattaaaggcgggagaaaataatttttcacgtccattaaatgtggaagaaattctggtggtaacctttacggaaatggcaacagaagaactcaagaaaaaaattcgtgagcgtataacagatgcgattaataaactcactgcctttgctaaaacccaagataaatccgcatttaaaaatgatgaatttcttaccgcactttgtgataatttagatatttttgaggcaattcatcgcttaaagttagctgaacaaaatatggatctggcggcgatttataccattcacggtttttgtcgccgtatgttgatgcaatatgctttccattctggcattcatttcaatttagaattaataaaagatcaatctgatttattagttcgttttgctaatgaattttggcgagagcatttttatccgttggattttgaatctgcgaattttatcgcgacagaattagtatcaccagcaaaggtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaattttagcgattattaccaatgaactggagaaagattatccaaaagatcagttgaaatcgttaaatcgtaaaaagtaccaagtaaagcgtttaggggattggattaataaaatcaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagagcttgaaaagcgcgttaatgccttaatgacaccagatttactaagcaaactcactctttatcattatcgacaaggcttacaacaaaaacttttagactataaactaaatcatcaagaaaaatcctttgatgatttattgcgtttgctttgtgaagccctgcaagatgcgcaaggggatgaattagcggaaatgattcgtttccaatatccttttgcgatgattgatgaatttcaggatacggattcacaacaatacgctattttttcaaaaatttatcgtgataatcccgaaaaaaatactggttttattatgattggtgatccgaagcaggcgatttatcgtttccgtggcgcagatatttttacttatctaaaagcctcagacgaagcccaatctcgctttgaactcactaaaaattatcgttcagagaagcatttggttgatggtgtaaatgctttattcgattttcctcaatcgccatttatttatcaaaatattaaatttactgctgttgattctcgtgatgatcatctgcgattttatttaaatggcaaagccgaaccagcttatcgtttttatctaactgaaagtgacaaagtgaataaaactgaaatggcaaaaatatgtgctatttctattcaacattggctaaaaagtgcggctgaaaatcaggcagtttttcaaaatgaagatactcgtaaaacattgcaagcggcaaatattgccgtattagtgcgtgataaaaatgaagcggctttagtaaaaaatgaattgcaaaaattagggatcgcgtcagtttatctttctgatcaaaatagcgtatttgatagcaatgttgcgaaagaattagcttgggtgcttaaagcctgtttgaatgtggcagaacgtccaattttgaacgcgattgcgaccgcactttttggcttaaatgcagcggatattcatcaaattcagcaaaatgaagcagattggcaacgttgggcagatagttttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaatcggcattgctcagttggtttgaaaaacaaattcaaggcgaaggtcgtcaagaggctcaaattcgtttagaaagtgaacgccagttggtaaaaatagtgacaatccataaatctaaaggcttagaatatgatttagtttggctaccatttttagctgtgccgagcaaagatccaagtaaaaaagacatcaatatttattattctaaagaacgagatgaaaccttatgggatatagaaaatcgcaatttaaacgctctttgtgaagaaacttttgctgaagaattacgtttactttatgtggctttaacacgtgccaaatatcaaatggcattcgcgttgcctgcacaatttgataaaaaatggaatgccttacattatgtattaagccaaggtgaaataggcaaggaaataaatttgtcgaattctaaagataccgagacgttgttgcaagcctttaaagaaaaaatgcgagataatgtggaaatctgtactaagccaaatctagaggcttttccggctttatctatcaatacaaaaaatgatgagcttaaagccgcagaatttacgggcaatattgagcaagattggcgaataaccagttttacttcaattgaacaaggtcatcgccgacaaaattatttcgctgaaagtgcggagaaaaaacacgctgtttttgatgacgcaaaagattacgatagtcaaaatgctattgaaatatccaccgcacttttaaacgaaaatgaatcaaatattttagatttaccacgaggtaaacaagtcgggactgcattgcatcgccattttgaaaattgctatttttctgatttagcaaatatagaagaaattgacaaattaagacaatccttacagttagatgaaacttttacagagccgctacaaaattggctacaacagatttcacatacgccactttctcatgaaataggaatagcattagctgatttggcaaataaagattgcattaaagaaatgccattttatctggctatttgggaacattttgatgttgaagagtttaatcgcacattgaaagcccatcatcatttaccaagcgagccacttcaatttgagcaaattcaaggaatggtgagaggttcaattgacttagttttccgccataatggaaaatattatcttattgattataaatctaatttcttaggttcaacccttgctgactacaatcaagaggcattgaaaaaagaaatgttacacagtcactatgattggcaatatttaatttatacgctggcattacatcgttatttacaaagcgttgtgcctcattacgattatgcacgagatttcggcggggtattttatcttttcttacgtggaatgaacggtgaaccacaatctggcgtattttacgatcgtccaagcgttgaattaatcacagaattagacggggtgttttaa

SEQ ID NO: 2236 - DNA, 1923 bp, H. influenzae strain 86-028NP
atgttatctgtattacacaaacttaaagagcagcgcattctttctcaaggtgattattattttgctaagttgatagctgataaacaatgtcatacggattatgcggaaccaatcaaaaatttagctatattattagccgcactttgtagttggcgttatacgcagggaaatacttgcagccaattagatcgctatttagaacataatttatttggcttggcttatcgcactacagaagaagactatttagctgaaattcgtgaaaagattggttatttagctgtggaagattggcaaaatgcgttgtgcgggcatatggcatttacgcaagatcccgtcaatcaaattgcaccaatggtatttcaatttggcgcgttgtatttctatcgtacttggcaagatgaatatcgtatcgcgcaatatataaaaaacactttaaaaaaacaccgcactttagccttttcttatgatgaaattcatcaaaaattagagaaatatttccctgaaaaacaggaaaaaacagattggcaaaaagtggcagtggcgacagcgattaaaagtccattttcgattattacgggtggcccaggaacaggaaaaaccacgacagttacgcgtttattgctcgttctacaagaattatttgattgtaaattacacatcaaattggttgcaccgactggcaaagccgcctcccgtttggaagagtcgattaaaaatgcgttaggttttatgcaagaaaaaatgaatgtatcccattcacttttcaatgcgattccacaaaaagccagcaccttgcatagtttactgggcgtgaacgcctttaatgattacacgcgctataacagccataaccctttgcaattagatgtgttagttgtcgatgaaacatcaatgattgatttgccgatgatggtaaaacttatcaatgcgttaaagcccgaaacccgattaattttattaggcgatcaggcacaattagcctctgttgaggcgggggctgtattgggggaattagctcaatttgttactcaaccttatagtcatgaacaagtcgcatacttactagcaacaacaggctacaaagtagaaggttccgattgttcaaatccaatacgtgattgcttatgccatctaacagaaagtcgccgttttgataaagattcaggcattggaaaattggctgaattcattcaaaaaggcaaagcagacgatagccttgagttatttgaccattatccgcaagaattgcactttaatgccctaaatgatgaaagcgatgcggtcaatcaagtggtgaaaagtgcggtggaaaattaccgcactttcttaaaaatgttggacgatttacgtaaacaaaaaattgatcctaacgctaaaaatgaacaaggcatttcctatgccgaagccattcaagcgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaatgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttccgaatttgaacacactgtcatggtgcttccaacagaagtaaatccagtactgtcgcgagaattagttttcacgggcgtcactcgtgcgaaaaaagaactcactgtatttgccgatgaaaaaatatggaaaacagcgattcgtcagaccgtcaaacgccagagcggattgggaaaattattggaagatttaaattag

SEQ ID NO: 2237 - DNA, 447 bp, H. influenzae strain 86-028NP
atgaaataccaaaaactcgaaaatcaagaatcaaattggaaatggatttacctaattcgtaaacatcgcgaaggggaaaatattactcgctacgaagaacgtagtttgcaagaagctaaagcccaagaattattagaatcccaaaattatccttcacaaattgaagaatggattaaaaatcatctttctccagccttaccaattaagcttgatcaagccattcgtgcccgccgtaaacgcttttttaatggagaaaaacaacataccaagaaaaaatccattgatttggaatatgctgtttggctacgtctttctaaatattctcgaaaaatgaagatgacactttcggaaacaattacctatatgattgacgaaagagaaagcaaggcacaatttgaaaatcaaatggcagcaatgaaaaccagtttgaagaatttattaaaataa

SEQ ID NO: 2238 - DNA, 1806 bp, H. influenzae strain 86-028NP
gtggtcaatttttctagaaagagaccagccgtgagttcattattttctcaacaacaagctattgagcaatctttaaattggcaggcattacaacctgatttggtaattcaagattttcctttagaaccagtggatttctgggcgttacaaccgaatgctacacagggtatcgatttatttttacgtcatccgacacgttccttactaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggagaggcgttaagtgcattgtattgcgatcaattccagcttttcggtagttttcggattcatccaagttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgagttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcttcaacttttgctgaaaaaactgcattaagtgcggtggattttgagggtatttttcaacaaaaattagcacaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggcatgatgattgcgcaagcttgcctttccaatatcttagatttgccctcgcaattgccattttctgcctcattagtgtttgaacagtcttatggtgaaattgatggtgatagtgcatctttggcgattttctgtgtgctagcaagcgctttagctgatttgcctttgcctcaacatatcgcaattacaggatcgattgatcaatttggacttgttcattctgttggtggtgtaaatgataaaattgaaggcttttttactatttgccaacgtcgcggtttgactggaaaacaaggtgtaatcattccaatgacgactattcagcaactgagtttgtctaatgaagtgaaaagtgcggtaaaaaatggcgagttttttatttatcctgtggaagatatttatcaggcttgtgaattgttatttgggcgtgatttgttagatgaaaacaaagattatacagaaaaaactgagcctttatctcgtcttattcaacgtcgtattgagggacgtgccgattctgaacgaaaaagtttttggcattttttccgctcctaa

SEQ ID NO: 2239 - DNA, 534 bp, H. influenzae strain 86-028NP
atgcaaaacacttgtacacttaataaaaaaaatagctattcttatgatgatttgctcgcatcaggtcgcggcgaattattcggtaaagaagggccgcaattacccgcgccaacaatgttgatgatggatcgtatagttgaaatgaatgaagaaacaggtactttcggtaaaggatacattgaagccgaacttgatattaagcctgaattgccattttttggctgccatttcattggcgatccagtaatgcccggttgtttaggattggatgcgatgtggcagcttgttgggttttatttaggctggattggtggcaaaggaaaagggcgagcattaggggttggcgaagtgaaattcactgggcaaattttgccgacagcgaaaaaagtagtttacagaatccatatgaaacgagtaattaatcgtaaactagttatgggaatggctgatggcgaagttgaagtagatggtcgtgttatttataccgcgacagatttaaaagtaggactattccaagatacctcagcattttaa

SEQ ID NO: 2240 - DNA, 729 bp, H. influenzae strain 86-028NP
atgatggcaaatgatgattttcaagaatatgtgaagcaactggtaacaaaacatcgagatgaacgaatttatccttttcaatatgaaggaaaaaaatattggttgaaacaacctgaaaaattgaaagggatttggctattattaaaaccccatcctaaaaaatcttttaaaaatgaattacatactttattgaagcttgctgaacaaaatgcgccagtgccaaaagtctcttattatagtgatcatttttttgtgttggaaaatgtgggactgactgtatcacaatggctatgcaataaaaatatagatgaacaacagaaatttttaattatttatgatgcttgtctcgctttgattgatttgcacgctaaaaatttgatacacggtcgtcctgctattagagatattacttgggataaagggaaggttacttttcttgattttgaatctcgtgcaaatagtcaaaatcaaaattgggtagttattcgggatatgttatttttctttgatagtttatgtcgagaagaagatatttcagacgattttattcaaaaagtagcgttgtattatcaagcttattgtagagtagaaaattggcagaatatgatcgtatttttgcagcgttttcgctgggtttattatcttttattgccttttaaaccttttgcaaagaaagatttaattgcagtttatcgcttatttgaaattttattaataaagaaaaaatga

SEQ ID NO: 2241 - DNA, 138 bp, H. influenzae strain 86-028NP
atgatgaagaaaatattttttatttttgtattatcaggcatattagctgcttgtgccatgggtggtggtattcgtgctggtggtggaagtaatggtgtaggattaggtgtggggattggatctggcattcgcttctaa

SEQ ID NO: 2242 - DNA, 270 bp, H. influenzae strain 86-028NP
atgtctctaagtactgaaaaaaaagcagcaatcgttgctgaatttggtcgtgatgcgaaagatactggttcttctgaagttcaaatcgcattattaactgcacaaatcaaccacttacaagctcactttgcagagcataaaaaagaccaccatggtcgtcgtggtttattacgtatggtttctcgtcgtcgtaaacttttagactacttaaaacgtactgatcttgctttataccaaagcacaatcgctcgtttaggtttacgtcgctaa

SEQ ID NO: 2243 - DNA, 372 bp, H. influenzae strain 86-028NP
atgaaatgcaaggtttataccgtcgttgttcctaatgtgcaatcagcaacattattgccaattatccgaaagaaagttaagcctgatagcattgtgtacacggatacctttcgtagttatgatatgcttgatgtcagtgaatttagccattttcgcatcaatcacagcacgcattttgctgaaaatcacaactacataaacggaattgggaatttttggaatcacgcaaaacgccatttacagaagtttaatggcattcccaaagagcattttgagctgtatttaaaagaatgtgaatggcgttttaacaatagcgaaataaaatctcaaatttccattttaaaacaattagttaaggggagtttggtctag

SEQ ID NO: 2244 - DNA, 117 bp, H. influenzae strain 86-028NP
ttggaaatgtttgaaggcaaaattgaagccgatgaaagctatttcggcagtactcgaaaaggcaaacgtggtcgcagtgttgcagggaaagtcgcggtattcgggcttctcaaatga

SEQ ID NO: 2245 - DNA, 1440 bp, H. influenzae strain 86-028NP
atgaaaaaattatcttcaatttccaccgcacttggttcctttttactttcagtgagttttagcctaccaactttcgccaatattaatgtttcagatttaacacaaaaattgcctgaaggctctaacgcaggtgttattgctaaaaatatcaatcaaaatcaaataattgctgattataatggctcaacctttatgctgcctgcgagtacacaaaaagtttttacagccgttgccgctaaacttgcattaggcgatcaattccaatttgagaccgcacttttgagtaatgggaaaattcaaaatgggaatttagatggcaacttaatcgtgagtttcacaggcgatcctgatctcacaagaggtcagctttatagcttacttgcagaattaaaaaaacaaggcatcaaaaaaattaatggcgatttagtattagatacctctgttttttctagtcacgaccgaggattaggttggatttggaacgatctcacaatgtgtttcaactctccaccagcagctgcgaatattgataacaactgtttttatgcggaactagatgcgaataaaaatccaggtgaaatagtaaaaattaatgtgcctgcacaatttccaattcaagtgttcggacaagtttatgtagcggatagcaatgaagcgccttattgtcagctcgatgttgttgtacacgacaataatcgctatcaagtaaaaggatgtttagcccgtcaatataaaccttttggcttaagttttgccgtgcaaaatacggatgcttatgctgccgcgattattcaacgtcaattaagaaaattaggtattgagttcaatggcaaagtcttgttaccccaaaaaccacaacaaggtcagctattagcgaaacatttatcaaaaccattacctgatttattgaaaaaaatgatgaaaaaatcggataaccaaattgccgattcattattccgagcggtggcattcaattactataaacgccccgcctcctttcaattaggcacattagcggttaaatccatattgcaaaaacaaggaattcgttttggtaatagcattttagccgatggttcgggtctatctcgccataatcttgtggcacctaaaacgatgctatccgttttagaatacatcgccaaaaacgaagataaattacatttaatggaaacttttcccatcgcaggtgtagatggcacgatcagtgggcgaggtggattaattagcccaccattagtgaaaaacgtgattgctaaaactggttctttgaaaggcgtttataacctagctggctttatgacaaatgcgcgaggggaaaaagtggcatttgtacaatttattaatggctactcaacgggcgatttagaaagcaaaacaaaacgtgccccattagtacaattcgagcgtaatttatataacgaactctataaatattaa

SEQ ID NO: 2246 - DNA, 477 bp, H. influenzae strain 86-028NP
atgcaacaaattccaatgactgtgcgtggcgcagaacaattacgagaagaattggatttcttaaaaaatgtacgtcgtccagaaattattaaagccatagcagaagcacgcgagcacggagatttaaaagaaaatgcagaatatcacgcagcgcgtgagcaacaaggtttttgtgaggggcgtattcaagagattgaaggtaaacttggtaatgctcaaattattgatgtcacaaaaatgccaaataatggtaaagtgatttttggtgcaacagttgtacttgtaaatacaaatacagacgaagaagtcacttatcgcattgtaggcgatgatgaggctgatattaaatctggtttaatttcggtaaactcgcccattgcgcgaggcttaattggtaaagaattagatgataccgttaatattacaacgcctggtggtgtcgttgagtttgatattattgaagtgaattatatttaa

SEQ ID NO: 2247 - DNA, 300 bp, H. influenzae strain 86-028NP
atgacaaccttatcaaccaaacaaaaacaatttttaaaaggtcttgcgcaccatcttaacccagtcgttatgcttggtggaaatggcttaaccgaaggcgtacttgctgaaattgaaaatgcacttaatcatcacgaactcattaaagtaaaagttgctggtgcagatcgtgaaacaaaacaacttattatcaatgcgattgtgcgtgaaactaaagcagcacaagtacaaactatcgggcatattttggtgctttatcgcccaagcgaagaagcaaaaattcagcttccacgcaaataa

SEQ ID NO: 2248 - DNA, 630 bp, H. influenzae strain 86-028NP
atgggaaagaaaaaacgttcagcgagttcttctcgttggctgaatgaacattttagtgatcaatttgtgcaaaaagcacataagcaaaagttgcgatcacgcgcttattttaagattgatgaaattcagcaaacggataaattatttaaacaaggaatgaccgtggttgatctcggtgccgcaccaggcggttggtcacaatacgtagtaagccaaattggtggcaaaggtcgagtgattgcttgtgatattttagaaatggatcccattgtaggcgttgattttctgcaaggtgatttccgtgatgaaaacgttttgaatgctttgctagagcgcgtgggcgaagctaaagttgatgtggtaatgtctgatatggcaccaaattttagtggaatgccatcagtggatattccacgcgcaatgtatttggtcgagcttgctttagatatgtgtaaacaagtcttggcaagcaaaggaagttttgttgttaaagtctttcaaggggaaggctttgatgaatatttaagagaaattcgttctttatttaatgtggtaaaagtgcgtaagcctgaggcatcacgtggacgatctcgtgaagtatatattgtggcaacaggctataaaggataa

SEQ ID NO: 2249 - DNA, 1908 bp, H. influenzae strain 86-028NP
atggtcaaaaatctagtgctttgggtggtagtggcagtcattatgatgacagcataccaaagtttcaattcatcttcggtagaaaattctactgattatacaacctttgtttacgatgtaagcaacggacaagtgacagcggcacgttttgatgccaatgaaattacggtaacgaaaaccgatggttctaaatattcaaccgtaatgccaccacttgaagataaaaaattgcttgatgatttattaagcaaaaaagtgaaagtggaaggcacgccatttgaaagacgtggttttttatcccaaattttaatttcttggttcccaatgttattccttgttggtgtatgggtattctttatgcgtcaaatgcaaggcggtggcggcaaagcgatgagctttggtaaaagccgagccaaaatgttgaatcaagatcagattaaggtgacttttgcggatgtggctggttgcgatgaagcaaaagaagaagtgggcgaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggcggcggacacgatgagcgtgaacaaaccttaaaccaaatgctagttgaaatggatggctttagcggtaatgacggcgtaattgttattgcggcaactaaccgtccagatgtacttgatccagctttaactcgtccaggccgttttgaccggcaagtagttgttggcttacctgatgtgaaaggtcgtgagcaaatcttaaaagtgcatatgcgtaaagtgtctgttgcacaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtacctgagcatgatcctgtacataaagtgacgattattcctcgaggacgtgcgttgggtgtgacattcttcttacctgaaggtgatcaaattagtattagccaaaaacaattagaaagtaagctttctaccttgtatgcagggcgtttagcggaagatttgatttatggtgaagaaaatatctcaacaggtgcatcaaatgatattaaagtcgcaactaatatcgcgcgtaatatggtgacgcaatggggattctctgaaaagttaggtccgattctttatacagaagatgagggcgaggttttcttaggtcgttcaatggcgaaagcgaaacatatgtcagatgaaaccgctcatgcaattgatgaagaagtgcgtgcaattgtaaatcgcaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagcctgaaagtgcggtagaaaataccgacaattttaatgtttaa

SEQ ID NO: 2250 - DNA, 831 bp, H. influenzae strain 86-028NP
atgaaactttacgcaaataataaatgtcttgatttaagcgttcctaagattatgggaatccttaattttacgcctgattctttttctgatagcggacagttttttagtttggataaagcgctttttcaagttgaaaaaatgttggaagaaggggcgacaattattgatattggtggtgaatctacgcgtcctaatgatgcggatgaagtctctgaacaagaagaattgcatcgtgttgtgccagtagtggaggcggtgcgaagccgttttgattgctggatttctgtcgattcttcaaaagcagttgtgatgcgtgaagcagcaagtgttggaatggatttgattaatgatattcgtgctttgcaagagccaaatgcgttagaaaccgcagtaaaactagctttacctgtttgtatcatgcatatgcaagggcaacctagaacgatgcaggcaaatcctcattatgagaatgtcgtacaagatgtattcgcttttttacagaaacgtactaatgaatgtctttctgctggtgttaaaaaagaaaacttaatttgggacatgggattttgttttggtaagtctgtacagcataattatcaattattacaaaatctgaatgaattttgtcatagtggatatcctgtgttagcgggattatctcgcaaatcaatgattggtgcggtgcttgataaacccgtcgatcagagagtgataggtagtgcggcaggtgcgcttattgcagcgcaaaaaggtgcaaaaattttacgcgtacatgatgttgctgcaacatcagatatgctcaaagtttggcaggcaacagaaaatgcctga

SEQ ID NO: 2251 - DNA, 1338 bp, H. influenzae strain 86-028NP
atggcaaatcgtaaatattttggaacagatggtgtacgtggaaaagtaggtagttatccaattacaccagatttcgcattaaaattaggctgggctgcgggaaaagtattggcttctcaaggttctaaaatggttttaatcggtaaagacacccgaatttctggatatatgttggaatcagcccttgaagcaggtttggctgctgcgggtttatctgctgcatttactggccctatgcctacacctgctattgcttatttgaccagaacttttcgtgctgaagcgggtatcgtgatctcagcctctcataatccttattatgataatggcattaaattcttttcagcaaaaggcactaaattgcctgatgaaattgaagaagccattgaagcgatgttagagcaaccgatggattgtgtggaatctgccgaattaggtaaagcaagccgtattaatgacgcagcaggacgctacattgagttttgtaaaggtacatttccagcacacttaggcttggaaggttataagatcgtggtagattgtgcaaatggggcgacttatcatattgcacctaacgtattgagagagcttggtgcggaagtcattgaaattggtacagatccaaatggtttgaatattaatgaaaaatgtggtgcaactgatgtgacagcattgcaagctaaagtagttgaaacgaaagctgatgttggtttggcttatgatggcgatggtgaccgcattatgatggtcgatcatttaggaaataaagtcgatggcgaccaaattctctttattattgcacgtgaagcattgcgctcaggtcaattaaaaggcggtgtcgttggcaccttaatgagtaatatgagcttagagattgcgttgaaaatgcttggtgttcccttcttacgtgcaaatgtgggagaccgttatgtattggaaaaaatgcttgaaaatgattggacgcttgggggggagaattctggacatattatcattgcggataagaatacaactggcgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgtgttatggtggaatgccaagatgctgaacttgcacaacaatgtgcagaagaaattgcagaagccgtgaaaaaaattaattaa

SEQ ID NO: 2252 - DNA, 495 bp, H. influenzae strain 86-028NP
atgaacatttttattatgcgtcacggcgaatcggaagtaatggctaatagtgataaagctcgtcgcttaactgcttatggtattaaacaagctttttctcaaggagaatggttaaaacagcatttaagcacgctagtaattaattcactagaccgtattttagtgagcccttatgtcagagctcaagaaacctttcatcaagttaatcaagcgtttgatttggagttagaaaataaatttgaaatttgggagggaataaccccttatggccatgcacattccgtcattgattatttagaagtgctaaaagacgagggcgttaaatctgtattgattgtttcccatttgcccttagtgggagaaattgttgctgaactgtatggaaaacgaaatccaatatcattttatcctgcaactattgctcaattattatgggatggtaataaatcagaaatattgatgcatcaagcatctcctgtaatttatttaaaataa

SEQ ID NO: 2253 - DNA, 576 bp, H. influenzae strain 86-028NP
atggagaaaataatgaaaaaattaacattagcattggttttaggttcagctttagccgtgacaggttgttttgataagcaagaagcaaaacaaaaagttgaggatacgaaacaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaaacagcatcagaaaaagcaactgaaataaaagaggcagtttcagaaaaagcaagtgagatgaaagaagctgcatcagaaaaagcaagtgagatgaaagaagctgcatcagaaaaagcaagtgagatgaaagaagctgcatcagaaaaagcaagtgaaatgaaagaagctgcatcagaaaaagcaagtgagatgaaagaagctgcatcagaaaaagtaggcgaaatgaaagaaaaagcaactgaaatgaaagaggcggtttcagaaaaagcaactcaagcagtagatgcagtgaaagaagcgacaaaataa

SEQ ID NO: 2254 - DNA, 1365 bp, H. influenzae strain 86-028NP; identical to SEQ ID NO: 661

SEQ ID NO: 2255 - DNA, 141 bp, H. influenzae strain 86-028NP
atgttttattacaattctgcaagcaagcaagcaagcaagcaagcaagcaagcaagcaagcaagcaagcaagcaatgctaatcttttcttttcatctgtcaagccaaccatgacagcttcacttatcagcacagtttgctga

SEQ ID NO: 2256 - DNA, 153 bp, H. influenzae strain 86-028NP
ttgctgatctcttctcaagcctttgcggcgagtgacaattcaattagtacgaattacggcattaaagagtttggggcgtatagcctgatcattggtaatttaaagaataatacaattaatagtaaaatttccaatcaggctttaacgagttaa

SEQ ID NO: 2257 - DNA, 159 bp, H. influenzae strain 86-028NP
ttgccacaagtggttggaaaagcgagtttttctgctgcggtgggcggttatggcagctgtaatgcgatggcaattggtgtcggctacacactaaaagcaaatatcaagttaaaaagcggtatcaattattcttttcttaaacacctgattttttcctaa

SEQ ID NO: 2258 - DNA, 597 bp, H. influenzae strain 86-028NP
atgttaaaggaagtgggtttcatttcttatataagttttaaaggaattaaaatgaatgttatttctgatcttgagcttcagcaaattcgcactcaaatgctgacatttgcacaattgcaagtaaatcaagctgatcttgctgaagatttagtacaagaagcctttttaagtgcattcaaaaatcttgataattttaagcatcaatctgcatttaaaacttggatttttgcgattcttaaaaataagattattgattatttacgtcagaaagggcggtttgttttagaaagtgaacttgaagatgaagataccaataattcattttttgatgaaaaggggcattggaaaccagaatattacccgagtgaattacaaggcgaagaagaaactgtgtattccgatgaattttggctgatttttgaaacttgtttgacttgtttacccgccaaacaggcaaaagtttttatgatgcgagaatttttagatctttcatctgaagaaatttgtcaagaaacgcatttaacttcgtctaatttacataccaccctttatcgggctcgtttacagttgcaaaactgtctttcaaaaaaactttag

SEQ ID NO: 2259 - DNA, 174 bp, H. influenzae strain 86-028NP
atgcgttgtcgccaagccactcgaatgatttccgaatcgcacgaacgttcattagatatacaagaaaaagtagggctaaaagtgcatttagctatgtgctcgcgttgtcgtcgttttcaaagaaattgcaaaaccttaagtatgatgatgaagaaatttaaagattcacattaa

SEQ ID NO: 2260 - DNA, 903 bp, H. influenzae strain 86-028NP
atgcccaatctccccctcttttctaaggtaaaaatctatatgcaatcacattccattccttcactttatcacaaagcgattagttttatggtatcagcgtacttttccattaccttgatgaatgtatttgtcaaaacggcttctcaaacaatccctgcaagtgaaaccttattttcacgctttttaatcggcttgcttttcttacttccttttgtgattaaagatcgcgattttaaagtggatactcgtcaatggaaatttttaatcctgcgtaatgccgcgggtgtatcgaatatgttgattaacttttatgtcgtgaagttcttaccgctttccatcgctgtcttattgatgaatacctctgccctatttatcccgattttattgctttttttccatcaaaaaacaccgcttaatgtgcttttatgtagcttaatcggttttcttggcgtttccattattttactcaccaatcacaatggcaatgttgatcctatttatgtgctgattggattatctggtgctgtattagcgggaatggcatttattggcttacaagaattaaacaaatacaacacaccaaaaaatatcgtattttattttcatctgattggtacgttcatgttaccagtcttctttattaaccaatggaaaatccctaatttatacgagcttggcttattactattggtgggcggtttcggattgattttccaattattactcacgcgcgcttttaaatacgcacccgccaatatcattactccttttgctttcactggcgtggttttctctagcgttttcgactggctcttttggcatcatacgcctaacctctatttttggctcggtgcagttataattgtgggcgcagtgagtttattggcgaagctgaagaaataa

SEQ ID NO: 2261 - DNA, 1062 bp, H. influenzae strain 86-028NP
atgaaactatcaaaaacatttctatttattaccgcactttgcagtgctacaccaactttagcaatacaaaattcaacatcatcatctggagaacaaaaaatggcaatggaaaatacacaaaacatccgagaaatttatcttgctggtggttgtttctggggtatggaagcatatatggagcgtattcacggtgtgaaagatgcgatttctggctatgccaatggtaatacggggaaaaccagttatcatatgattgggctaaccgatcacgcagaaacggtaaaagttacttacgatgcaaaccaaatttcgttagataaattgcttaaatattattttaaagtgattgatccaacgagtgtaaacaaacaaggtaacgaccgtggtagacaatatcgcacagggatttattatcaagatggggcagataaagcggtgatcgaacaagctctcgcccagcttcaaaccaaatataaaaaaccagtgcaagttgaggtacaaccgattaaaaattacatcgtagcggaagaatatcatcaagattatttgaagaaaaatccaaatggttattgccatattgatattaccaaagcagatgaacctgtgattgatgaaaaagattatccgaaaccgagtgatgcagaacttaaagcgaaattgacaccgttgcaatattccgttactcaaaataaacatactgaacgctcttttagtaacgaatattgggataatttccaaccgggtatttatgttgatgtcaccacaggagagcctgttttctcttcaaatgataaatttgaatcaggttgtggctggccaagttttacgaaaccgatcattaaagatgtggtgcattatgaaaccgacaatagcttcaatatgcaacgtaccgaagtgttaagtcgtgcgggcaatgcccatttaggacacgtttttgacgacggcccgaaagataaaggcggtttgcgttattgcattaacagtgcatcaattaaatttattccgttagctgaaatggaaaaggcaggatacggatatttgattcaatccattaaaaaataa

SEQ ID NO: 2262 - DNA, 642 bp, H. influenzae strain 86-028NP
atgttagatcagcaactccttattggaactgtatttttagctgggcttgcttcttttctttcgccttgtattttcccgattattccaatttattttggtattttgagtaaaggtggtaaaaaagtcctgaatacttttttatttattttagggctttcccttacatttgtcagtttaggctttagttttggctttttagggaatattttatttagtaacactacccgcattatcgctggcgttatcgtgattattttgggtattcatcaacttggcatttttaaaattggtttgttggaacgcacgaaattggtggaaataaaaacatcaggaaaatcgaccgcacttgaggcatttgtgcttggtttaacctttagtcttggttggacgccttgtattggcccgattctggcttccgtgttagctttatcaggcgatgaaggctctgcactttacggtgcatctatgatgtttgtttatgtcttagggcttgcgaccccgtttgtactgttttcgttcttatctgacagcttgctcaaacgtgccaaagggttaaataaacacttagacaaatttaaaatcggtggcggaattttaattatcgtgatgggtattttattaattacgaataatttttcgtaa

SEQ ID NO: 2263 - DNA, 471 bp, H. influenzae strain 86-028NP
atgaaaaaactactatcaatatttctaatggcattcagcctaaacgcttttgcacaaactaatttagcggatgtgcaactcaaagatttaaacaatcagccagttactttaagccaatataaaggcaaacctgtgtatgtcaaaatgtgggcatcttggtgtccgatttgcttggctggattagctgaaattgatgatttaagtgcggaaaaagatcgcaattttgaagtgattaccattgtttcgcccgatcacaaaggcgaaaaagacaccgctgattttattgaatggtacaaaggattggaatataaaaatatcacggtgcttttagatgaaaaaggcgaaatcattgacaaagcaagagtgcgtggctatccgttcaatctctttttagatagcgatttaaacctgaaaaaaaccgtaccagggcatttaggtgcagagcaaataaaagtttttgcagggaaataa

SEQ ID NO: 2264 - DNA, 324 bp, H. influenzae strain 86-028NP
atgacaacagaaattaaaaaacttgatcccgatacagccattgatattgcttacgatattttcttagaaatggctggagaaaatttagatcctgcctatattcttttattcaacctacaatttgaagaacgcggtggtgtggaatttgttgaaaccgccgatgattgggaagaagaaattggtgtactgattgatcctgaagaatacgctgaagtgtgggtgggcttagtcaataaacaagatgaaatggatgatgtctttgctaaattcttaatttctcaccgagaagaagatcgcgaatttcacgttatttggaaaaagtaa

SEQ ID NO: 2265 - DNA, 732 bp, H. influenzae strain 86-028NP
atgatcgaacttagtcacgaagaagaattgcgttataaccgtcaaattattcttaaaagcgtagattttgacgggcaagaaaaacttaaagcaagcaaaatgctgatcgttgggcttggtggcttaggatgtgcagccagccaatatctcgcagcggcaggcgttggaaatttaacactgttggatttcgatacagtttcgctttcgaatcttcaacgacaagtcctacactgcgatacgcgcttgaatatgccaaaggtggaatccgctaaaattgcactggaacaaatcaatccacatataaacatagagacgattaatgcgaagttggacgaagaaaaactggctgaaatcattccgcactttgatattgttttagattgtacagacaatgtggaaatccgtaatcaattggatcgccaatgtaatcatgcaaaaattcctcttatttctggtgctgcaattcgaatggaaggtcaggtttccgttttcacttatgaaccaaatacgcctacttatcgtgatctcagcaaattatttggacaaaatgtattaagctgtgtggaagctggcgtgcttgcaccaatcgtcggtattgtgggctgcattcaagccttagaagcaattaaagtgcggttaaaaatcggtaagaatttgtgtggacgcttattgatgattgacggtttttcgatgaatattcgagaaattaaacttccaaccaatatggaataa

SEQ ID NO: 2266 - DNA, 1215 bp, H. influenzae strain 86-028NP
atgcttacattggatcaagctcgctcgaaaatgcttgaacagcttcccttcccgactcaaactgaatacctaaatttacaagaagccgccaatcgaatttgtgcagaagatattatttcgcctatcaatgttccctctttcgataactcagcaatggatggttatgctgtacgtttatcggatttacaacaatctttaaccctttcagtggcagggaaatcttttgcaggtaatccattcaaagaggaatggccatcaaaaagtgcggtcagaattatgactggcgcgatgattcctgaaggcacagatgcagtgataatgcaagagcaagtaacactcaatgaagacggcaccatcacttttagtgaattacctaaaccaaatcaaaacatccgtcgtattggtgaagatgtaaaaaaaggggatgttgtattagaacaaggcgcaccgctcaccccagtttccttgccattattagcctctctaggcattgcagaagtaaaatgctatcgtcaattaaaagtcggtgtactctcaactggcgatgaacttgtggaagtcggcaagccattacaaagcggacaaatatatgacactaaccgtttcaccgtaaaattactgctagaaaaactaaactgtgaagtcattgatttaggactattacctgataacgaagctgaatttgaaaaagcatttattgccgcacaaagccaagccgatttagtgattaccagtggcggtgtttccgttggtgaagcggatttcactaaagcagtattggaaaaagtaggcaaagtaaatttctggaaaattgcaatcaaacccggcaaaccattcgcttttggtaaattagaaaatgcttggttctgtggtttacccggcaatcctgtttccgcattagtaacattctatcaacttgtacagccattaatcgctaaactgcaaggacaaaaacaatggaaaaatccaccgcacttttcagccattgctacaatgaatttgaaaaaagcagtgggacgtttagacttccaacggggtttttattacatcaatgaacaaggtcaaattgaagtgcaatcagtaggtttccaaggttctcatctctttagtgcttttgtaaaaagcaattgttttatcgtgttagaacaagaacgtggcaatgtctctgcgggcgaaacagtgacaattgagcctttcaatcatttattaggataa

SEQ ID NO: 2267 - DNA, 657 bp, H. influenzae strain 86-028NP
atgagcaaaatttcactggatgcactgaatgtaagaaatgccttgattgaaaaaggtattgagacacctatgattgatccaacacaggctaaagatgaacgtcgagaaagcattgcgaaacacatgcatgaagtaatgaagctgattggattagatttgcgagatgatagtttagaagaaacgccaaatcgtttagctaaaatgtttattgatgagatttttagtggaatggattatgccaattttcctaaaatgacgaaaatcaaaaatcagatgaaagtcagcgaaatggtgcaagtgaatgacatcactctaacaagcacttgtgaacatcattttgtgacgattgatggtaaagtttgtgtagcgtactatccaaaagattgggtgattggtctttctaaaattaatcgaattgtctcgttttttgcgcaacgtccacaggttcaagaacgcttaactgagcaacttttgacagcatttcaaaccattcttgaaaccgatgatgtggcggtatatgtgaaagcgacccatttttgcgtgaaagcacgtggtattagagatacaaatagttatactgtcacatctgcttatggtggcgtattcttagaagatagagatactcgtaaagaatttttagccacagttcaaaaatag

SEQ ID NO: 2268 - DNA, 324 bp, H. influenzae strain 86-028NP
atgataaattgtaatccgcacgtaaaatgtgcggatttttatttcgggaaattaaatatgctatgtgccatttataaaagtaaaaagaagttaggaagttacctttatgttgctaatagagaggatttttctttagttcccagcgttttactcgaacattttggtaaaccagaattagtgatgatgtttaatctgcttgggcgtaaagcactatacaatgtagattgtaatgaagtattggaaacaattaaacgccaaggattttacttacaaatagcaaaacaagatgatggtttatttaatagcttgagtgagatcaaataa

SEQ ID NO: 2269 - DNA, 729 bp, H. influenzae strain 86-028NP
atgagtagcttttttgtcgcagggacagatacgaatgtggggaaaacaacagcagcgcgcgcaatgattcaagccttgcaagagcagggagtgcaagttgtcggctataaacctattgcttgttgtggagaagagagtatttatcctatcgcacaatcagaaaatacatctgattatgatcatttcgtaaatgctgatgtattaacgctgatgcattcaacaaaagaaaatgtgtcttatcaggatattaatagttatacttttagccactgtgcacccatgctcacgcaagataaaatgcgaattaaattagataaaattaattatgatttaacgcatttgaatcaaacttatcaatctgttgtggtggaaggatcttttggtttaatgacaccaatggcagaaggaaaaagttttgcagattggattactcaacgaaaaatgccagtagtacttgtagttggaattaaagatggttgtgtaaatcacgctttattaacggtaaaggttatccaacagttgggtgtgccgttattaggttggatagcaaatcgaattaatccattattaagccattatgcagaaattgttgatttacttgttgaacatattgatgcgccgcttttaggtaaaattccttatttacataaacccgaagaacaagaattagggcattatttaacgaatatagatcgattaatgtatatgcaaacagagttcataaaataa

SEQ ID NO: 2270 - DNA, 879 bp, H. influenzae strain 86-028NP
atgagctacgcgaaagaaattgatacattaaatcaacatattgcagattttaataaaaaaattaatgtctcttttgaattttttcctcctaaaaacgaaaaaatggaaacccttctatgggattccattcatcgtttaaaagtcttaaagcctaaatttgtgtcagtcacttacggcgcaaattcgggagaacgtgaccgcactcacggcattgtgaaagccattaaacaagaaacgggcttagaagccgcaccacatttaactggaattgatgccacacctgaagaattaaaacaaattgcgagagattattgggatagtggtattcgccgtattgttgcgttacgcggtgacgaacctaaaggttacgcgaaaaaaccattttatgcgtcagatcttgtggaattactccgttctgtcgctgattttgatatttctgtagccgcttatcctgaagttcatccagaagcaaaatccgcacaagcagacttaattaatttaaaacgtaaaattgattcaggtgcaaaccacgtcattatacaatttttctttgatattgaaaactacctacgttttcgtgatcgttgtgcatcaattggtattgatactgaaatcgtacccggtattttacctgttactaattttaaacaactccaaaaaatggcatcattcactaatgtgaaaattccagcgtggttagttaaagcctatgatggtttggatgatgatccaactacacgtaatcttgtagcagcaagtgttgcaatggatatggtaaaaattttatctcgcgaaggcgtgaatgacttccacttttatacattaaatcgtagtgaattaacttatgctatctgtcatatgttaggtgtaagaccttaa

SEQ ID NO: 2271 - DNA, 429 bp, H. influenzae strain 86-028NP
atgaaaacttttgtagcaaaaccagaaacggttaaacgcgactggtacgtagtagatgcgacaggtaaaactttaggtcgtttagcgactgaattagcacgtcgtcttcgtggtaaacacaaggctgagtacactccacacgtagatactggtgattacatcatcgttatcaacgcagacaaagtggcagtaactggtcgtaaagaaacagataaactttactactggcacactggctatgtaggtggtattaaacaagcgactttcaaagaaatgatcgctcgccgtcctgaagcagtgattgaaattgcggttaaaggtatgttgccaaaaggtccattaggccgtgcaatgttccgtaaattaaaagtgtatgcaggtgctgaacaccaacacgctgcacaacaaccacaagtattagatatttaa

SEQ ID NO: 2272 - DNA, 393 bp, H. influenzae strain 86-028NP
atggcagagaatcaaaactacggcacaggccgccgcaaaagctcttcagctcgtgtatttatcaaaccgggcagtggtaaaatcactatcaatcaacgtgaattagatgtttactttggtcgcgaaacagcacgtatggtagtacgtcagccattagagttggttgaattaactgataaattagacctatacatcactgttaaaggtggtggtatttctggtcaagcgggtgcaatccgtcacggtatcactcgtgcattgatggaatacgatgaaacattacgcccagcacttcgtgcagctggtttcgttactcgtgacgcacgtcgcgttgaacgtaaaaaagtgggtttacacaaagcacgtcgtcgtccacaatactcaaaacgttaa

SEQ ID NO: 2273 - DNA, 639 bp, H. influenzae strain 86-028NP
atgtccagcacatcaagtaaacgttcagtaatgacccttttttcaaataaagatgatatttattgccatcaggtaaaaattgttttggcagaaaaaggtgtgctttatgaaaacgcagaggttgatttgcaagctctaccagaagatttaatggaattaaatccatacggcactgtgcctacgttggttgatcgtgatctcgtattatttaattcacgcatcataatggaatatcttgatgagcgttttccacatcctccattaatgcaagtgtatcctgtttctcgtgctaaagatcgacttttaatgttacgtattgaacaagattggtatccaacccttgcaaaagcagaaaatggcacagaaaaagaaaaaacttcagcattaaaacagttaaaagaagaactattagggattgcaccaatttttcaacagatgccttattttatgaatgaagaatttggtttggttgattgctatgttgcaccattattatggaaattaaaacatttaggtgtggaatttacaggcacaggaagtaaagcgattaaagcttatatggaacgtgtgtttacacgtgattcttttttgcaatctgtaggtgaagctgcaccaaaaaatttaatggatgataaataa

SEQ ID NO: 2274 - DNA, 453 bp, H. influenzae strain 86-028NP
atggaatataaatcttctcctaaacgcccttatttattacgcgcctattatgattggctagtagataatagttttacgccttatttagttgttgatgcgacttacttaggtgtgaatgttcctgtcgaatatgtaaaagatggacagattgtattaaacttgtctgccagtgctacgggcaatttacaacttacaaatgatttcatccagtttaatgcgcgttttaaaggtgtctctcgtgaactgtatattccaatgggcgcagcccttgcgatttatgctcgtgagaatggcgatggcgtgatgtttgaacctgaggaaatttatgatgaacttaacattgagccagatactgaacaaccaacaggtttttatgaagcagtagataagcctaaaaaacgagaagaaaaaaagaaaacaaaatcagtttcccatttaagaattgtggattaa

SEQ ID NO: 2275 - DNA, 1878 bp, H. influenzae strain 86-028NP
atgactaataatatgaacaattatcctcttttatctttaattaattctccagaagatttgcgtcttttaaataaagatcagctaccacaactctgtcaagaattacgtgcttatcttttagaatctgttagtcaaactagcggacatttagcgtcaggtttaggcactgttgagctaaccgttgcgctgcattatgtatataagacgccatttgatcagttaatttgggatgtgggacatcaagcttatccacataaaatcctaacgggtcgccgagagcaaatgtccacaattcgccaaaaagacggtattcatccttttccttggcgtgaagaaagtgaatttgatgtattaagtgttggtcactcctctacgtctattagtgcgggattaggcattgccgttgccgcagaacgagaaaatgcaggtagaaaaacagtatgcgtcatcggtgatggcgcaattactgcgggaatggcatttgaggcattaaatcacgcgggggcattgcatacagatatgttagttattttaaatgataacgaaatgtctatttcagaaaacgttggtgcattaaataatcatcttgcgcgtattttctctggctctctttactctacgcttcgtgatggcagtaaaaaaatccttgataaagttccgccaatcaaaaactttatgaaaaaaaccgaagaacatatgaaaggtgtaatgttttcgccagaaagtacattatttgaagaactcggttttaactatattggcccagtggatgggcataacattgatgaattagtggcaatgcttacgaatatgcgtaatctgaaaggcccacaatttttgcatataaaaacgaaaaaaggtaaaggatacgcacccgcagaaaaagatccgattggtttccacggtgtacctaaatttgatccaatcagtggcgaattgcccaaaaacaatagtaaaccaacttattcgaaaatttttggcgattggctatgtgaaatggcagaaaaagatgccaaaattataggtatcacacctgcaatgcgtgagggttcaggtatggtagaattttcccaacgcttcccaaaacaatattttgacgtagcgattgcagaacagcacaccgtcacgtttgccacaggacttgcaattggcggatataaacctgtcgtcgcaatttactcgacatttttacaacgtgcttacgatcaattaattcatgatgttgccattcaaaatctccccgtgctatttgcgattgatcgagcagggatagttggcgcagatggggctacacatcaaggtgcattcgatattagctttatgcgttgcattccaaatatgatcattatgacgccgagtgatgaaaatgaatgccgtcaaatgctctatacaggttatcaatgtggaaaacctgcggcagtgcgttaccctcgcggaaatgccgttggtgtaaaacttactcctttagaaatgcttcctattggtaaatcacgtttaattcgaaaaggtcaaaaaattgcgattttaaattttggtactctattaccatccgctttagagttatcagaaaaactcaatgcaacggttgtcgatatgcgttttgtgaaaccgattgatattgaaatgattaatgtgcttgcacaaactcacgattatttggtcacattggaagaaaatgcaattcaaggtggagcgggatctgctgttgcggaagtactaaattcatcaggaaaatcaaccgcacttttacaacttggtttgccagattattttattccacaagcgacacggcaagaagcattggcagatttaggattggatacaaaaggcattgaagaaaaaattctcaactttattgcaaaacaaggtaatttataa

SEQ ID NO: 2276 - DNA, 891 bp, H. influenzae strain 86-028NP
atgggtcacttttctgaagaattacaacaggttcaaactcgtatcaatcgctttttagaagctcaatttgagggcattgaaagtcataatgcacttttgcttgaggcgatgaaatacgcattattacttggcggtaagcgagttcgccctttcttagtttacgcaacaggtcaaatgcttggtgcagagaaacaaaccttagattacgctgctgctgccattgaagccattcacgcctattccttaattcacgatgatttacctgcaatggatgatgacaatctacgtcgtggacatcctacttgtcatatccaatttgatgaagctacagctattcttgcgggcgatgcgctgcaaagtttcgcatttgaaatattaaccaaaacaccgaatatttctgctgaacaaaaactggctttaattcaaattttagcgcaaggcgctggcgtacaaggaatgtgcttagggcaaagtttagatcttatttctgagcataaacagattagtttaagcgaattagaattaatccatcgtaacaaaacgggtgcattgctaattgccgcattaaaattaggtttcatttgttctccacattttaccgacaaaaggttagaacaatccttaacacaatatgcggaagccattggtttagcctttcaagttcaagatgatattttagatattgaaggcgatagtgcagaaattggcaaacaggtgggtgccgatcttgatttagataaaagtacatatccaaaattacttggattaagtggcgcaaaacaaaaagcgcaagatctatatcaaagtgctttgtctgaattagaaaaaattccttttgatacaaccgcacttcgtgcattagctgaattcgttattaccagaaaaagttaa

SEQ ID NO: 2277 - DNA, 255 bp, H. influenzae strain 86-028NP
atggcgcgtaaacccgcatcttcacaagattttgaaacaacgttagcgcagttagaaaatattgttacacatttagaaaatggcgatctaccgttagaagaagcgttaaaagaatttgaacaaggtgtgcaactcgctaagttagggcaagaacgtttacaacaagcagaacaacgtattcagatcttattgcaaaaaacagaagacgcgccactgaatgattataaagggaatgattatgaagggaatgcttaa

SEQ ID NO: 2278 - DNA, 1458 bp, H. influenzae strain 86-028NP
atgaaatttatcgttaaactttttcctgaaatcatgattaaaagcgaaactgtgcgtaaacgtttcgcaaaaattttaacctctaatatccgcaatattttacagaaatatgatgaagaaactgcagttgtacgtcactgggattacattgaagtgcggtcaaaaaatgaagagaatcgtgaagaattaatcgccttgttacaacgtattcctggtattcatcattttttagaagttgaagaaaaaccgtttaccgatttacatcatatttttgaattgacgcttgcggatgtcgcgcaacaacttcaaggcaaaaccttttgcgttcgagtaaaacgtaagggtaaacataaatttagttcgattgaagcagaacgttatatcggcggtggattaaatcaacatattgaaagcgcaaaagtgcggttaaaaaatccagatgtgactgttcgtattgatattgaagatgacaaaatgatgttagttaaaacacgtcacgctggtattggcggttatccgattggtacgcaagaagatgtgctttctttaatttcaggaggatttgattcaggcgtatcgagttatatgttgattcgtcgtggttcccgagttcattattgtttctttaatcttggcggtgcagcccatgaaattggcgttaaacaaatggcttatcatatttggcaacgctatagtgcttcacataaagtacgctttattacgattaactttgagggagttgtcggtgagattttagagaaagtcgataacggacaaatgggcgttgtattaaaacggatgatggtgcgagccgcaagtaaagtcgctcaacgtttcaatattgaagcgattgtgacaggggaggcattaggacaagtttctagccaaactttaaccaatttacgcttgattgatgaagccgctgatgccttagtattacgcccgttaattacgcacgataaagaacaaattatcgcgatggcgaaagaaattggtactgacgatattgcaaaatctatgcctgaattttgtggcgtgatttcaaaaaatcctacgatcaaagcggttcgtgaaaagattctagaagaagaagggcattttaatttcgagattcttgaaagttcggtgcaaaatgcgaaatatttagatattcgccagattgcagaagaaacagaaaaagaagtcgtggaagtcgaggcaatttctgtattaggtgaaaatgaagtgattttggatattcgtagcccagaagaaacggatgaaaagccatttgaatcaggtacacatgacgtcattcaaatgccgttctacaaactttcttctcaatttggtagccttgatcaaagtaaaaattacgtgttgtattgtgaacgtggtgtgatgagtaaattacaagccttatatttgaaagaaaatggtttttcaaatgtgcgtgtatttgcaaaaaacattcattaa

SEQ ID NO: 2279 - DNA, 321 bp, H. influenzae strain 86-028NP
atgcgtaatcaaactaaacagcatcttgaacagcttcaaattaccatgcagcagcttaatttatggcaaacgatgccccctgctgcagaggcgtttttaagtgaagaacctttttcaattgatacgatgtctgccgaagagtggctacagtgggtatttattccacgcatgcaggcattattagaaagtggttcagccttgccacataaaattgctatttctccttatattgaagaagcaatgaaggaatttgatgagttacaacaactattaactcctttagttgctttagaagaacttctgaacaataaccaatgctag

SEQ ID NO: 2280 - DNA, 720 bp, H. influenzae strain 86-028NP
atgctagaaattttatatcaagatgagtttctcgttgcggtgaataagcctgatggtatgttggttcatcgcagttggttagatcctcacgaaactcaatttgtgatgcaaactttacgagatcagattggtcagcacgtatttcctattcatcgtttagatcgaccgacatctggcgtgttgttatttgcattgagcagtgaaattgcgaatttaatgtgtgaacagtttgaacaaaagtgcgttcagaaatcttatttggctgtagtgcgagggtatctacagggaaaagagcggatagattatccactaaaaattcaattggataaaatcgcagataaattttctcaagaagataaagagcctcaagaagcagtgactgattatgaaggattaaaaatagtcgaaatgccttatcctgctgggcgttatcaaacggcacgttattctttagttaaattaatccctcatacaggtagaaaacaccaattacgtcgccatatgaaacatatttttcatccgattttaggggatacgcaatatggtgacttacatcaaaatcgtgcattaatgtcacatttaggttgttctcgattatttttacattctaatagtttgtcttttattcatccaataacgaaagagcaaataacaattacagcaggtttagatgaacaatggcatcaattaataaatcaatttgggtgggaaaatgtttga

SEQ ID NO: 2281 - DNA, 159 bp, H. influenzae strain 86-028NP
atgtttgatattaacttaacacacgaacagcaacaaaaagcagttgagcaaattcaagaacttatggcaaaaggaattagtagtggagaagcgattcaaatagtggcgaaagcactacgagaaattcataaaaatgataaaaaaactccagataattaa

SEQ ID NO: 2282 - DNA, 219 bp, H. influenzae strain 86-028NP; identical to SEQ ID NO: 649

SEQ ID NO: 2283 - DNA, 477 bp, H. influenzae strain 86-028NP
atgacacccgcaattgatttacttaaaaaacaaaaaattccttttatcttgcacacttatgatcatgatccgaataatcaacattttggtgatgaggcagccgaaaaattaggcattgatcctaaccgctcttttaaaaccttacttgtggcggaaaatggcgatcagaaaaaactcgcttgttttgtgcttgcaacggccaatatgctgaatttaaagaaagcagcaaaatctatcggtgtgaaaaaagtggaaatggcggataaagatgcagcacaaaaaagtacaggttatcttgtaggaggaattagcccgctaggtcaaaagaaacgcgtgaaaaccgtgataaattcaaccgcacttgagtttgaaacgatttatgtttcaggcggaaaacgtgggctaagcgtagaaattgcgccacaagatttagcaaaagtattaggtgcagaatttactgatattgttgatgaataa

SEQ ID NO: 2284 - DNA, 954 bp, H. influenzae strain 86-028NP
atggacgcaaccttaaatattgcgatagcagcagaatttgaattaagtgaaaaaattgtagagcgtttagaacaaagtacgcttgaaattagcaaagtttctattgttgaaataataccttttgaagaagaacaaaatattcgttttcgcaataaaggcgttgaacaacttgcgccaaatgaagtagagtgggctgattttaattatgtcttttttgcaggaaaacttgagcaagttgcccatattgcgcaagcagcagagcagggctgtattgtcattgatatgttaggcgtttgtagtgcgctttcggatgtgcctgttgttgttccaacggtaaatgaatcacaattacttgaattaagacaacgtaacattgttagcttgcctgatcctcaagtaagccaacttgctttaacgcttgccccgattttacaagaaacgaatctcaatcaagtatttgtcacctctttattgccgacttcttatacggatgcggaaaccgtgacgaaacttgcgggacaaacagcccgtttattaaatggtattccattagacgaagaagaaactcgcttagcctttgatgtttatccgcatcaagcacctaatttatcgaatcaattacaacgaatttttccgcaattagatcgtgctacattccactcaatccaagtgcctgtattttatggattggcacaaaaagtcaccgcactttcagattatgatttcgactatcagcctcaaaatagcgagcttgtcgctttagaagaaaccttaattacgcctgtgcttaatggagaacaagaaaatggcgaagaatcagtaaaacttcatttaagtcaaataagtgcggtagaaaatggcgtagaattttggtctgtggcagatgaacaacgctttaatctcgctttactttcagtgaaattgttggaaggaatttatcagcaaggttattaa

SEQ ID NO: 2285 - DNA, 807 bp, H. influenzae strain 86-028NP
atgagccgttttgaaacgcaatttgcgacacttaacgcaaaaaatgaaggggctttcgtgccgttcgttaccctttgcgaccctactttcgactgctcttttgagatcatttgcacacttgtggataacggtgcagatgctttagaactcggttttcctttttccgatccgctactcgatggcccagttattcaagccgcgaataatcgtgctttaactgcaggtcatagcagtgaagatagctttaaactattggaaaaagtgcggtcaaaatatcccgagattccgattagcttattactttgtgccaatttaatttttgctaaaggtttagatgctttttatcaacgctgtgcagaagttggtgttgatgctgtgcttgtagcagatattccgttactcgcaaaagaagattatgtacaagcggccaaaaaacacggcattcaacccgtctttatttgcccgccaaatgcggatgagaaaacaattcaaggcgtagcgaaaaatagcgaaggctatacctatttagtctcacgtgcaggcgtaaccagtgctgaaaatcaagctcacgcagcaaatttagatacccttgtagaacaacttaaagcccactatgccccgccaattttacaaggcttcggcattgcacagcctgcacaagttaaagaagccttagctttgggagcggctggtgcaatttcaggttcggcaacagtaaaaattattgagcgaaatttagataatcacgagcaatgtttagctgaattagctgaatttgttcaaacgatgaaagctgcaacaaaataa

SEQ ID NO: 2286 - DNA, 1194 bp, H. influenzae strain 86-028NP
atgtcagacacacttcttaacccttattttggcgaatttggcggaatgtatgtacccgaaattttagtgcctgttttgaagcaattagaacaagcctttgtggaggctcaaaatgatcctacattccaagcagaatttgctgatttactcaaaaattatgcgggcagaccgaccgcacttactctttgtcgtaacttaaccaaatgcacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaaccgccctagcttgtgctatgttagatatgccgtgtcgtgtttatatgggtgcaaaagatgttgagcgtcaatcaccaaacgtgttccgtatgcgtttaatgggggctgaagtaattcctgtagaaaaaggctcttgttctttaaaagatgcctgttgtgaagcgatgcgtgattggtcagcaaactatgaaaccacccattatttacttggaacggcggcaggccctcaccccttcccgacgattgtgagagaatttcaaaaaatgattggcgaagaaaccaaacgtcaaattctagaacgagaaggtcgtttacctgatgctgtgattgctgcggttggcggtggttctaacgcaattggtatgtttactgattttattgatgaaccaaatgtgcgtttaattggtgttgaacctgcagggaaaggcattgaaagcggtgaacatggcgcaccattaggtcatgcaaaagtgggcatttatttcgggatgaaatcccctttaatgcaaaccgaagatggtcaagtagaggaatcttactctgtttcagctgggttagacttcccttctgtcgggccgcaacatgcttatttaaatgagattggtcgtgctgattatgtatcgattaccgatgaagaagcccttaacgcattccaagaattggcaaaacacgaaggcattattcctgcattagaaagctcacacgccttggcttatgccttgaaattgattaaacaaaatcctgaaaaagaacaacttttagtggttaatctttcaggacgaggcgataaagatatttttactgttgataaaattttaaatggaggaacgaactaa

SEQ ID NO: 2287 - DNA, 759 bp, H. influenzae strain 86-028NP
atgagaaccacaactgcattagtaacaggtgcaaccgcaggctttggcttagcgatctgtaaaaaattgatcgaagcaggctataaagtgattggcacgggtagacgtgcagatcgattggcagaaatccattcacaattgggcaataattttctaccgcttgcctttgatattcgtgatgaacaagtcacaattaacgctctaaatacccttcctgaaggttggcaagcggtcgatttattagtgaataatgcaggtttagccttgggattagagccagcacataaagcggatttacaagattggtatcagatgatcgataccaacatcaaaggattggttactatcactcgccttgtgttgccaaatatggtcgctcgtaatcacgggcagattatcaatttgagttcaattgcaggtacttatccttatgcgggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagccgcaaaagtctatgaaaacgtgcaatcggttcagcctgaagatattgcgaacattgtattatggcttcatcaacaacctgaacacgtaaacattaatcgtattgaagtaatgccaaccgctcaatcttttgcaggaatgagcgtttcaaaagaaaaataa

SEQ ID NO: 2288 - DNA, 1035 bp, H. influenzae strain 86-028NP
gtgagcaacacacaactgagctataaagatgctggcgtcgatattcacactggaaatgaattagtcgaacgtatcaaaggcgatgtaaaacgcactcgccgctctgaagttatgggcggattgggtggtttcggcgcattatgtgctttacccaccaaatataaagagccaattttagtttctggcacagatggcgttggcacaaaattacgtcttgcgattgacttgaaaaaacacgataccattggtcaggatttagtggcaatgtgtgtgaatgacttaatcgtacaaggtgcagaaccgcttttcttcttagattactatgctacagggaaattagacgttgatgtggcagcaagtgtgatcaaaggtattgcagatggttgtgaaatgtctggctgtgcgttagtgggtggcgaaaccaccgaaatgccaggaatgtatcacgaaggcgactatgatttggcgggtttctgcgtaggcgtggtagaaaaatcagagattattgacggcacagcagtgaaaacaggcgacacgcttatcgcactcggctcaagcggtgcacactcaaacggttattcgttaattcgcaaagtgcttgaagtaagtggtgcaaatccagcggatttattagaaggtaaaccacttagcgaacactttttagcaccaaccaaaatctatgtaaaatcgattttacagttgatcaagcagaccgaagttcacgccattgctcacttaacaggtggtggtttctgggaaaatatcccgcgtgtattacctgcaaacacaaaagcagtgattgatgaatcaagctggcaatggcctgcgatcttcaactggttacaagaaaaaggcaacatcagtcgttatgaaatgtatcgcacctttaactgtggcgtaggtatggtaatttcattaccagaaaaagaggttgaaaccgctcttgcattgcttgaacaagcgggcgaaaaagcgtgggttatcggcaaaattgaacatcttggcgaaggcgaagcacaggttgagattcaataa

SEQ ID NO: 2289 - DNA, 639 bp, H. influenzae strain 86-028NP
atgaaaaaaattgccgtccttatttctggtcaaggaacaaatttacaaactattattgatgcctgccatttaggcgatattcccgccaaaattgcttgtgtggtaagtaacaaagctgatgcttacggcttagttcgagccaaacaagcacagattccgcaagcggtctttcttcgcaaaaatttttccaataacctcgaaatggacgacgccattggcgattatttgcaaagcctagccgtagatttgatcgtccttgctggttatatgaaaattcttaccccaaaatttacccaacgttttgcagggaaaattttaaatatccatccttctcttcttcctaaatacgcaggcttaaacacctaccaacgtgcgattgaagcaggcgacaatgaacacggtacaaccgttcattttgtcaatgaagaagtagatggtggtgcgattgtcttacaggcgaaagtgccaatcttccctgaagatagcatcgaagaagtggaggctaaaacccgtgagcaagaatatcaaatttatccgcttgtgattaaatggtttaccgaagggcgattaagacttaaagataatttggcatatctagatgggaaagctctgccaaaatctggatatgcaaatgaataa

SEQ ID NO: 2290 - DNA, 837 bp, H. influenzae strain 86-028NP
atgaaaaagacattgattacaggattattggttttagctggcacagcacaagctcatgaagtttgggttcaagcaccgacgaaattaacatctggttctgtattaaaagcagaattagcttatggggattacccttatgtagaaaaaattcctgaagcacgtttaaaaatttttgcaccaatggaaattattcgtcaagatggagaaaaacaaaccttaatccaaaaaggcgaaaactatcaatatcaatcagagaaagcattgtccgatggttcttattgggtaacagcgacttataaacctactttttggtcacaaaatgctgaaggttggaaaatggataatttgaaagaattagaaaatcccacttattgtgaacaaactcaaatgtttggcaaaagtcttgttaccgttggtaaaaaaccattaaatgcagaaatggcaatgacaagagttggtttaccactggaaattgttcctttgcgtgatcctagcaaagcgaaatcaggcgaaccgttccctgttcaaattttctaccaagatcagccattagcaggcgaaactgtcatcgcaaccgctgatactattatcgtgaaagatcttgaagcaagtacaggtcatcgtgaaccacaaggtttttcaggtaaaacagatagtcaaggacgtgtgaatatcattccattaattgatggtatttggaaaattaaagttattcataaaacaccatttgcagatcaacaaatttgtcagcaatctgcaagctatagcacattaattttaccggttggtaaaggattagctaaactacctccaaaaccagaacaccatcatcactaa

SEQ ID NO: 2291 - DNA, 1023 bp, H. influenzae strain 86-028NP
gtgcttgataaaaataaatttatccaaattaatcttgtaccttgccatttttgctattcttttttatcctatgcctcaattttggaggctattatgaaatttaaaaatattctcgttgtacttaatcctagtaatgaaaaacagtacgccctagctcgtgcagtgcgtttagttgaagaacaaaaaaatgaaactaaggtaaaaatcaccgcacttttatcagtctatgatttatcttatgaaatgtcagctttactttcttctgaagaacgttcagaaatgcatcaacaagtaattgaaaaacaccgccatgtggttcaatattacttagataaatatgcaaatccagaaattgaattacaatctcatattgtgtggaatagcaatgaagctgatgcaattaacgaagaagtagaaaataataattacgatctagtcgtaaaatatactaaagacgaagaaaaactgacgtctcttatctttactcccattgattggcaacttcttcgtaaatgccctattcctgtcttaatggttcgtgatggcgattggaaacatcaacgccgtattcttgtggcggtgaatgtttctggagaacaagaatatcaagatgaatttaatcaagagctggtagaaacaggtatttcactcgcggaaaatctaaatcgtggtaatgtccatttggtggcagcctacccttccgcgccaatcaatatggcgattgatttacctgaatttaatacttcaggttatgaaaacggtattcgaggtcagcatctcattaatatgaaagcgttacgtcagaagtttgggattgatgaagatcatactcacgtacgcgaaggtttcccagaggaagttattcctgaagtggcgaaagaaattgaagctgaattagtgattttaggcacagtgggacgaacaggtttatctgccgcattattaggcaatactgcagaacatgtgattagtaaattaagttgtaatttattaggcattaaaccatctaaaaaagacgattaa

SEQ ID NO: 2292 - DNA, 774 bp, H. influenzae strain 86-028NP
atgaaaaatttcgttgcaggagctcaatcagggcgcaaaattcaatcaggcggttgtgcgattcattgtcaggattgcagtattagtcagctttgtattccttttaccttaaatgaacaagaattagatcagcttgataatatcatagagagaaaaaaaccgattcaaaagtctcaagtattgtttaaagcaggagattctctcaattcaatttatgctattcgttctggcacaataaaaagctatacgattagtgaatctggcgaagaacaaattacttcatttcatttgcccggtgacctagttggttttgatgccattactcaaatgcaacaccctagttttgcacaagctctagaaacggctatggtatgtgaaattccttttgatattttagatgatttggcaggaaaaatgccaaaactacgccagcaaattttacgtttgatgagcagtgaaattaaaagtgatcaagagatgattttattgctatctaaaatgaatgcagaagaacgtttggctgcttttattcataatctttctaaacgctattctgctcgaggtttttcagcaagagaatttcgtttaacaatgacacgtggcgatattggtaattatctaggtttaacagtagaaaccatcagccgcttattaggccgctttcaaaaactcggcgtgattagcgtacaaggcaaatatattacaatcaatgatttaaatggtttaattgaattaactggtacgaataaaacaaaaattacattagttaaataa

SEQ ID NO: 2293 - DNA, 357 bp, H. influenzae strain 86-028NP
ttgaacgaaattacgccaacaaagcgtggagaaaagcacgaatttaatcggctgaatcgctttttacgccatccagttacggataaatatatatctgatgttagtcggataggggatgaggaattgtgttttgatattaagtctagtgtgcttgatgcaacattccgaaaactcaaaaaacttgccgagcgagaatatttgcattttcacgacacacggcgtgaggcattgactagactatctaaaaaagtagatgtgatgacattagccaaaatatctgggcataaagatatttcgattttacaaaatgtctattatgcccctgatatggcggaggtggcggaattactcgattag

SEQ ID NO: 2294 - DNA, 390 bp, H. influenzae strain 86-028NP
atggaaccaattaaactttcgcagaaagccgaagaagaaattgtgaatgcggcaaaaatggcggcgttatctaatttgaccgagaaaagccaaaatttaattacgcttgaggatatcgcaatatattttgggcgacactatcaaaccgttgccaagattatttcaaaactgcctaatttcccaaaacccgttacagtcgatcaacaaaattctcgcccacgctatatcgcaggcgaagttgttcgttggggcggatcaatgctaaacatattagctaatcgagtaattccgccacctccgccatatcaggggcataatagacattttgtaaaatcgaaatatctttatgcccagatattttggctaatgtcatcacatctacttttttag

SEQ ID NO: 2295 - DNA, 252 bp, H. influenzae strain 86-028NP
atgacacacttaaacttaattcctgtttttaatggcttaatccaaaatcaacccgttcaactttgcaacgctcgtgaacttcacgcattcgtagaaagcaaacagcaatacactgattggatcaaaaaccgcatcaacgaatatggcttcatccaaaatgaagactacctcgtcatcaccgaacgcaccaacggacgcccacgcaaggaatatcacattaccctcgatatgggcaaagaactcagaaattaa

SEQ ID NO: 2296 - DNA, 1272 bp, H. influenzae strain 86-028NP
atgaaaaccgttaaagcaagactgactgagttaaaaaacttaattaatacaaaaatcaacgaagactatgagtggatgggcgaaataaaatcacccgaaattatcaaagaaatagagcaactttatcccttaatagagaaaatagaaaaatctggaaaaagtcttgaaatttcctatgcaaaatatatttctcttcaattaattaaaaaaataattcgcatcctcaataaaaaaagagcgagtaataaatgggatgaatatgatgtaaattcatttattttatctctaatcaaactaagaatgacaatcaaggaattatatttaattgaagttaagggtgaattaagaacagaagaagaactcaatgctattgctgcagatatatccaaagcaaaattgaatttagaagagcacatctcacttgaagagcaattagtagagaataaaaaggagttcgaaaatttaaaaaactcactgattacactcaaaaaatcttataacgacgcacaagaacaaataactgaaatttcccagtggcacgaacagtcagagaaattaagtggcgacatttcgaactatgaattcaccgcacaaaataatcttactaaaattacgacattagcaaccacagcggaaaccaataaaccccaaatcgaaaaatatcatgaagatattgaaggtatgattaaattattcaataaacaaaaagaggagattgaaatgattattgaagacgccaaccgagcaagcatggcaggttcgtttaaaactcaatctgaaaatatcgatagtaaaatgaaagctgtagataaaattttgcttgggtcacttgttgcaacatctgttatttcattgttcaattattcaacaagcctgagtgcagcagacagccttaatattttacaatttcttgctaagtccattgtgacaatcccgttacttgtcatcgcctggttaaaagcaaaagaacgggcttatctctttagattaagggaggattataactacaaatattcctcagcaatggcatttgaaggttataagaaacaagtacaagaacaagaccctaaattacatcagcaacttctgcaaattgccgtggataatttggggataaatccaaccaaagtctttgacaaagatttaaaaagcacaccacttgaaacaattatcgatggagtaggaaaacgcctggataaagctgttgatggtattaaaggagaggtgaatgacattccaaagaaaacaaaagaattaattgatgatgaataa

SEQ ID NO: 2297 - DNA, 204 bp, H. influenzae strain 86-028NP
atgaaaaaaatagcagcagataaaatagctcttgttatggcaagagatattttaaaaacaaactctcaatatttgcgagaagttaatgagtatgtggccgaagatattgccagatttgtttcaacattatcatcaagattgcaagaatctattgatgatagcatttccagttcagatatttttaacgcccataagaatcaataa

SEQ ID NO: 2298 - DNA, 159 bp, H. influenzae strain 86-028NP
atggaagaaaaacaagaaaaaagcctatctgataaagataaaaatctaatcaaacaggctgtattagaaagtgctgataaaaatacaaatttaacaccaagtgaattagctgagagtgtatgttcggcagtgatgtttattgattcttatgggcgttaa

SEQ ID NO: 2299 - DNA, 222 bp, H. influenzae strain 86-028NP
atgcaagaagaaatgaaacgctatgcaatttcttatcacttcgacggcaaaaggtgggcgacagatgtttacgcccattcattcgaagaagcggaagaaaagctaaaagcaatgtcccaaggtactgttgacggcgagattcacctttcagtttacattcctgaaaatccgctatcgaaagtatcaaggttgattacaagaatagctaaaaagtttatgtaa

SEQ ID NO: 2300 - DNA, 336 bp, H. influenzae strain 86-028NP
atgcaaactatttatgtaaaagatttcagccaatatccaggtccacgttacattaaagatggtaaagctagtggagaggaatttagagattctattcttatcccagcaataaaaagggatcctgatatcattcttaatttagatgacacagaaggatatggctcttcatttcttgaagaaacttttggaggagcaattagaaaaggtatttctccagaggttgttttaaatcttgttaaaaaccttatttcaaatgacgaccatgatattattgacgaaattaaaagttatgtagaaaaagagattgagattttatctttgaaggataataaatga

SEQ ID NO: 2301 - DNA, 1080 bp, H. influenzae strain 86-028NP
atggatattcgattatggagatctattgttagacaaagaacattacgagctctcacaagtaaagaaaagaaaatcagacaaagaggcggaaagcctaaatataaacatcttgctcataaatcctttaatctttttgaggttatcgccccatataaaattattttagctaaagaaatagggtatgaatttgtagcatttaaagaagagctcgaagaaaaagcaaaactagcagcacgaagtcgaagtcgcctgaaactaaattttcgggacactgatattatcgatgctgccgcttgtagcgttttaatagctgttttagatacgataaaatcgcaatatagaaccttgaaatttcaaattgtaagaccaaaatcaaaaccagcagatcatcgtaaacatattccctatgatgttgatgctatattttgtcatataggactatataaatccttagggtttaattatacatcttcatcttctcaagaaaatgtgaaatgttggcattatgtttatagtgatagtgcagatggcgaaatcacaaagccactattagatgaacttaaaagtatgggggtgaaagggatatatcctagttacattgaagcgattgcaaatgcggtagaacatgcttacgcccaaaatatttatagtgaacgagaatttcctataaaacgttggtggatgttgcttgctatcctagaaggaaaattgtcactttttgtttgtgatttgggtcacgggatccctaataccctagaaaaaacacagaaagcaaatgtactttctgctatttggaatagactaaagcagctggggaaaccgacaaaagattgtttatatataaaagcctctaccctcattaaagaaacccgaacaggattgggacatagaggaaaagggggaagtgatattcgagcatttattgacaaaacaccaggaagcaggctaataattcgttcaaatcgaggaatgtatgtgtataatggcaaagataagccagatttaaccaaagaatctagatactctattaatggtactgttgttcagtggaacattccgctacaagaaattaaggaataa

SEQ ID NO: 2302 - DNA, 699 bp, H. influenzae strain 86-028NP
atgacagatttagcaagccgacttaatgaattaatggctaaacaaggcaaaaatattgtggatttacaaaaagctgttggcgtaacctatgaaatggctagacgttacactttaggcactgcaaccccgagagataataaaattgaagctatagcgaagtactttggagttacccctgctcatttgaaatacggaacagtcgattctttagaaaatcaagtaacttctaatgtgaaagacgttggctcattcgacttatgggatcgcaatactccactaaatagcgatgaatacgccgttccgttttatcaagacattcgccttgctgctggaaacggatttgctgatgacatagcggactataacaacttcaaattgcgtttttccaaatcaacactacgtaaacaaggcgtacagtacgaaaatgcggtatgtgtgattgctgacggaaactcgatggagcctgttattccggatggaacaacagttggcattgatcttggtaataaaacaatccgagatgggaaaatatacgcaataaatcacggtgggctactacgcataaagctactttacaatatgccaaacgaacaagtgaaaatccgcagttataacaccgaagaacaccctgatgaaatagcagaactacaagatatttctgtgttagggaaagtgttttggtattcagtattattatag

SEQ ID NO: 2303 - DNA, 189 bp, H. influenzae strain 86-028NP
atgctaccaatcgaaaaagcttatgaaatcgtgggcggtatttcggctatggctcgacatttcaatcttaccccttgggctgtttccaagtggcgtgaaaaagtacctgcggaacgttgcgcaaagattgaagaacttacagatggaaaagtcaagaaatccgaattacgtcctgatttgtgggattaa

SEQ ID NO: 2304 - DNA, 441 bp, H. influenzae strain 86-028NP
atggaaatgaagaaagttattatcgaaatggttgatcggattcctggggggagaagtgcggtagctggattcctaggttttaccgaaagtgaattaaagaatcgtctttatcaaacaaagggtcagcgattcaaaaatgaagaattaattgcgattcagcaagaatatggctgcacgcaatttattgatgaactatgccgtttggctggtgggcgttttgtacctgatgtagcagagaatgaattagacaaggttgagcttgctaatttacaactgcacgagctttccgcacgaggcttgttatttgctgcattagaaacagcgttagaagacggcgaaatcacttcgaaagaagaagacaaaatacgtcaagcattgagtaaacatttggcagcgacgcaacattcgattgaatgtgcgattgtgttacacaagaaataa

SEQ ID NO: 2305 - DNA, 675 bp, H. influenzae strain 86-028NP
atgaatcaattattaacgatttcgaaagaaaacacaagcactttgacgatgagtagtcgtgaaattgcggaattaatcaataaaaaccacagcgatctgtgtcgttcaatcgaaagacttatcgcaaaagaggtgatttgggggtatcagccaatggcttacacccatccacagaacggtcagacttattatgagtaccatctaaccaaacgagatagtttaattgttgttgctcagaattgtcctgaatttactgcggcaattgtcgatcgctggcaagcgttggaaaatcaacaaaaaccaaccgcacttattccgcaatctttttctgaggcgttgatgttagccgctcagttacaagcagaaaaagagcgtaatgcgcctaaagtcgcttttgttgatcactatgtggaagtagggacgagtaaatcatttcgtgagacggcgaagattttaaaaatgcctgagcgtgcattagtcaatcgcttggtggaagataaatatttgtatcgtcaatctggcgtgcttttgccttatcaatcggcacgcaccaaagatctttttacggttaaaacaggtaccgctgaacacggtcacaattacacacagacacgtgtaacaagcaaaggcattgaatttattgcgtcacgttatgcttcggagttgatgttatga

SEQ ID NO: 2306 - DNA, 759 bp, H. influenzae strain 86-028NP
atgagtatgcgattaatggttcaagcaatgaattgtaaggttggtaatcctgctagaaaacttgtgcttttaaaactggctgataatgccaatgatgatggaatttgtttcccaagttatcaatacattgccgataaatgcgagatgacccgacgtagtgcaatcaatcacattgaatatttaatcaaaatgggattagtaagcaaaaaagaacgtaaaaataaagatggttccatctcaaatttatactttttacaccttgaacaaggtagtgaaaattttgcactgggtagtgaaaatatttcactaggtagtgaaaattttgcactagggggtagtgaaaatatttcacccagaaccagtcactctttagaaccagtcaatgaacctaaaaaaactacgcaaaaaagcgaagccgaaatgttgcttgagcagttcggtattaccggacaactggcgaaagattttatcgcacaccgcaaagccaaaaagggcgtcattaatcaaacgcaactcaaccgtctgcaaaaacaggcggacaaggctgggatttcgatttgtgaagcggtggaaatttgcatcgaacgcaactggcagggatttaacgcatcgtgggattggcgtgatgaaaaactgcgaccaaattcaccgcacttagggcaatcacaccgcaacaaacccaaatttgacgatacgcagacaggctggtctgcaggaatgaatttcatagtggacggtacacaatggcaaattccataa

SEQ ID NO: 2307 - DNA, 642 bp, H. influenzae strain 86-028NP
atggcaaattccataacacaaaaccaaattaacacgctcccaccagaacgcacacagcgtgcggaagagacgattaactggctctttcaagagcttaaatcgatttttcctggttggcgtgcagcctttgaaaccggagcggattatctctctgctaaaaaaacttggttgcgtgtgttggtacgagaaaaaattacgagacctcagttggagaatgggatttgtgaagcggaaaaatcgcttgataaatttttacctagcgtagggttgtttgtttattggtgcaaagcctacgactatcacgcactaggtttaccgaacgaagcggaattataccaacgttataacactttcttaggctatgcccgattcaatcgggatgaatttcaatatcgttcaaaagtggaattttggttgcttaaaaatctgtacgaaaagtgcaagaaaaaatcggaagaggacacgttgaaagctattccgaaattactcacaaaagcggcagaaaaagtgcggtcgaattttccttttgaggatattccgaaaatgattcctgaaaagccaagtttttacgataaagcgaaggctgataaggcgcgcgatagcttgatggcaatgatgaaagggaaaggggcattgcaatga

SEQ ID NO: 2308 - DNA, 225 bp, H. influenzae strain 86-028NP
atgacaagctataaatgcccaaagtgcggtgcggaattagaggatttttatacgccagattattttatatcgagcagcgaatgggatgacgatcgttttcgctgtaacggtcacttaattgagccgataccgtttccgcaggtaagtaaatacagtgcagtgaatcgaacaaaatcttgcggttattttgggttggaagatttaggtgtggagtacaaagaatga

SEQ ID NO: 2309 - DNA, 417 bp, H. influenzae strain 86-028NP
atgagccaatataaacctttctttttacgcgatcaacgcattaaaaataattgcttggatttaatcaaagagctgccaatagacgataaaaagccattggtagtcaaaatccaaccaataacacgctcacttgagcagaactcaaaacttcacgcactactaagcgatattagcaaacagtgcgaatttaacggtaaaaagcgagacattgacacgtggaaaatgattatggtatcggctcacaaaattgcaacaggcggtcaggctgaaatggtaatcgggcttgagggggaagttatcaatctacgagaaagcaccgctcaaatgagcgtaaaacgactagcaagcctaatagagtacattaccagttggggcgtgcaaaatggcgtgagatttaacgatagatgggggttttaa

SEQ ID NO: 2310 - DNA, 390 bp, H. influenzae strain 86-028NP
atggtgagagggcattggctaaaagctcttcaaaaagaggtaaataaatttataagattgagagataaaggacaaccttgtattgcttgtggaacggtatggaaacctagttttcaagcgtctcattttattccgcagggaagaagctcatttttaagatttgatgagaggaatatccattctggctgtatcagatgcaatcttttcgtaggtggcggaaatatacatggatatagaccaagactagtcgagaagattggcgagcaagaggttgagtggttggaagaaaatcaacatcgaattaaaaaatgggaaatttctgagcttaaagaaatgctaaaactatacagattgaagaacaaggaattagaaaatgaaatgcaagattga

SEQ ID NO: 2311 - DNA, 630 bp, H. influenzae strain 86-028NP
atgtataaagctgattgcgtttgccaaatgcactattttagatttatgagaaacggaacttatgatcttcttccgaaaccaatccgaaaatacagaagacacaatggaaagggttatcagttaattttcgaaccaagacaccaattagcaatgagcgatgggtatgtttatgagcatagatttgtgatttatagcatttatcaaaataatttacctaactgcaagctttgtggctgcaagctaacttggagcagttgtcacatcgatcatattgataatgacattaccaacaacacgctagaaaaccttagaccaatttgccgagcttgtaacgtaatgagaagtcacacattaatacctaaatatacacacaaaggtcattctaaaataacttttaatggattaacaatgacagcagctgagtgggctagacaagatggcgtaacagtagctgggaatacaatcttgagaagaattagagatgggtggagcatagaaagagcattatttgagacaagttcaacacatccaaatgcagcagttaagcacactactactaagtataaaaatagatttgaagtgaaatctactggaataagcttagatttaagattgcaaggcgatgattaa

SEQ ID NO: 2312 - DNA, 279 bp, H. influenzae strain 86-028NP
atgaaatgtgatgctcgttatgctgaaaaatatcgtatgcgtcctataagcgatgaattaggcatggaaattgatggctaccttggtgtaattagaaaagtcacaccagaactttatgatgtattcgttctgacttatatcaagagatgggaaaaacaagaaatttggcgatatttacatatttcacggcgtgaatatttcaatcgattgaaaacggtaaaaacatcacttttattgctattatcaacagaaggcaagcaatgtttatttattgcctga

SEQ ID NO: 2313 - DNA, 978 bp, H. influenzae strain 86-028NP
atggagcaacatatggtttctacctccttaacggctgaaaaacgtaaagaacgagccgagaaagcagcgttagcacgctgggaacataaaaaagcactagaagaactccctttagctattcacgaaggcgtattaagcattggtgataaatcgcttgatgtggcagtgcttcaaaatgacttacgcattatttcaagtgcttctgtttttgaagcattagatcgcccaaatcgtggttctcgtggtggcgcaataacagaaaacgaagaattgatcaaactccctgcgtttatggatgcaaataatctaaaaccatttattaatcaagatgttatagatgtgatcaaaggggttaaatatcgcaccaaagacggtaaaattaaggaaggatatgatgcgactattttacctgtcgtgtgtgatatttatctacgagcacgtgaagaaggggcgttggttggtaagcaacaaaacaccgcccaaaaagcagaaattctaatccgctctttagccaaagtgggcattgtggcattagtggatgaagtcaccggctatcaagatgcacgagccaaagacgcactcgcaaaaatttttgaagcctttgtcgcaaaagaattacaaccttgggttaaaacctttcctttagactattacaaggaattatgtcgtttatatggcgttcaattccctccgaaaaataataatcaatttccacaattcttcgggcatattacaaacaacgccgtgtatgcccgactcgctccagagttattaccagaactcaaaaaatcggcaagtaaacaagcaaaaaaagtaaaattacaccagtttttaacggaagacgtagggcaccctaaattgcgtgaacatttatcttctatcgttacacttttaaagctatctaaagataaagataatttttatgaaatgttagataagatacaccccaaactcacacttcaggaaggacaagaatag

SEQ ID NO: 2314 - DNA, 786 bp, H. influenzae strain 86-028NP
atgttcgacagtgcgactaatacaataccgaaagggaataagtccgctggattcttgaccagttttgagctgtcgaacgcccgatttatcgggggcttccatcaaaaggaaatcaagatgactactcaaatccaattctcaatatttaatttcaaaaattccccagttcgcacgattaccgatcctaatagtgaaatttggttctgtggcacagatgtgtgcgatattctcggttatgtaaatgcgcctgatgcaatgaaaaaacattgtaaagaagctggtatagcaaaacgctatatcagctatccaagcggtagaaaggaagcgatctttatcaatgaaccaaatctttaccgtctgatcatcaaatctcgtaaaccagaagctgaaccatttgaagcgtgggtatttgaagaagttcttccgcaaattcgtaaaacaggaaaatatcaacttcaaccgcaacagctcgccttgccagaacccgaaaagaaattcagttttgaatttaccgagtatgaacttcaacagcttgtttggttgtggttcgctttcatgcgtggcatcgtcacattccaacatatcgaaaaagcctttagagttttaggctcaaatatgagttcacaaatctacgggcaggcttacgagtatctaagcgtgctacgctctaccaatcaaatcttaaaccgcatcacaagtgattttgacatcgaccaaatgacaaactggcgtgtattaaaacacttgcgaggctttaatccaaaagcagtcaaaatcgacttctaa

SEQ ID NO: 2315 - DNA, 183 bp, H. influenzae strain 86-028NP
gtgtggcggatttttacacctcaaattcacgaaaaaggatacattatgttcagaattctctttgcggtggcgttgttatgggcagcatacgaactcaatttaaaccaagattgcgatgggtatatttgcgacacgtcatcactaattaccgcacttcataaaccgcttgacagtgcacactaa

SEQ ID NO: 2316 - DNA, 357 bp, H. influenzae strain 86-028NP
atgccaattaaagagcctgatgtgtgggcgttaatatggtcttggttgcaaacaaatcttagttctagctcagcacagagtgctttttgggcgttatttatttctcttttaagatttgggtttatgcgtaaaaagccagctattcgttatgttttaattgatgcggctatgtgtgcatccattgcgggtgttgcagtgccaatttgtacgcatttatttgggcatacagaatattcttcatttcttggcacgatgattggttttgttggtactgaaaaaattcgcgagtttttatttaaattcattaatcggagaattgaaaaagatgacaatgatgatttccgaagtgacatttaa

SEQ ID NO: 2317 - DNA, 492 bp, H. influenzae strain 86-028NP
atgcagcaagcgatgtttttggctcaatgtggacatgaaagtggcggatttacaagatttaaagaaaatttaaattattcttggcttgggctttctaaaactttccgtaaatatttcccagaccctcttatagcgaagaaatatgagcgcaaacctgaacttattgccaatcgtgtttatgctaatcgtctaggtaatggcgatgagaaaagtggagatggttggaagtatcgtggtcgtggactgattcagatcacaggtaaggataattatgccgcgtttagaaaatggttaggtagagatattgagccagatgatgtggcagggaatttagatttatctgttaaaactgcagtgtggtattggaaatgctatgagttggctgagcttaattctgtggaaaaagttacgcgaagaattaatggtggactaaatggcattgatgagcgttgcaagctctatcgagcattaatggtaacggataatgactaa

SEQ ID NO: 2318 - DNA, 324 bp, H. influenzae strain 86-028NP
atgactaagtacatttacatggcgttagcgggtgttgtcgtggttttgattggtgcattgcgttaccaatctagcgttatagatgagttggaaataacgacaaaacaacaagaaaatactatccagcaacaagaagatgctaacaaatcattaagtcttgcgttacaacaagagcgttatgccattattgagcaacaagagcgtaataatgaaatagaaaggatagcaacagaaaatgctgaatcagttaaaacaatcattaagactcaaccttgtgctcacactcgtttgcctcagtctgttcttgaccgcttgcacgaataa

SEQ ID NO: 2319 - DNA, 282 bp, H. influenzae strain 86-028NP
atgctgaatcagttaaaacaatcattaagactcaaccttgtgctcacactcgtttgcctcagtctgttcttgaccgcttgcacgaataaaatcacgactaaaccagaatatatttatccgcctcaagcctatactgcaccttgtgtcaaaacagcatttactggggaaacatacggcgatgtagtcatacagttagttaaggtaaccgcagagcgagataagtgcgcaagccaagtagatcatcttaataagtggattaatcaagcaaaaggtggtaaatag

SEQ ID NO: 2320 - DNA, 279 bp, H. influenzae strain 86-028NP
atgaaccatttattaacattttatgaaaaaatcatctttaccaatccacttgagacaggtattccagaagcggttgccaaattagctttattgaacgattattctgcattgcgtgcttggcgtgaacacttaggtttaacacaagcggaagtggcaagccgtttaggcatttctcaagctgcttattcacaacacgaaaattcacagaccttgcgtaaaagcactcgcattaaaatagcgacagcacttggcattaattccgctcaattagatttttaa

SEQ ID NO: 2321 - DNA, 513 bp, H. influenzae strain 86-028NP
atgtcagacgtgaaaggaaaatctacgtctggtcgtggattaacacctaaacaagaaaaattttgccagctttatattgagctggggaatgccagtgaagcatatcggcagagttatgattgccaagatatgaagtccgaaagtataaaccgattggctaaaaaagaattagataagatcaagattagatcaagggttgatgtgcttcaacaagagcaccgacaacgccataatcttaccctagataatatcattgcggacttgcaagagtatcgtgatatttgtatgggaagaaagccacttactattaccactgtggtaaaaaatgctcaagaaggaacggcacaaagcgttaataccgaatgtttcgtttttgaaccgacaggtgcaaataaagcccttgaattgcttgggaagcatttagggatgtttaccaataaagttgatgtaacaactgatggcaagcccttacctactgtgattaatgtgacatttagcgatgagccagcttaa

SEQ ID NO: 2322 - DNA, 1344 bp, H. influenzae strain 86-028NP
atgagccagcttaatattcaatttcctacgaaattccgaccgctctttgaatctatttggccgtttattattttctacggtgggcgaggttcaggtaaaagttttagtatcgctagagcattagtattgcgagcctatcaatcgcctgttcgagttttgtgttgccgtgagatccaaaaatccatttctgattcggttattcagatgttggcagatcagattgaaatgttaggtctacaaaatttcttcgatgttcagaaaacgcaaattatcgggcaaaacggttcacgcttcacgtttgctgggctgaaaaccaacatcacatcaatcaagtcaatgacgggcattgatgtagtttgggtagaagaaggcgagaatgtttcaaaagaaagttgggatatattgattccaaccattcgtgaagacggttcgcagattattgtgagctttaacccgaagaatattcttgatgatacctatcagcgttttgtgattcatccgcctgagcggtgtaaatcggtcttagtgaattggcaagacaacccatattttccgaaagaattaatggaagatatggagcagatgcgtgagcgtgattatgaactttatcgtcacgtttatgagggcgagcctgtggctgattccgatttagccattattaagcctgtatggattgaatgtgcggtggatgcgcatctcaagctcggttttaccgctaaaggaatgaagaaagttggctttgatgtggctgatgagggtgcggatagtaacgataatgcatttgttcacggttctgtggtgcttgacattgaagtttggaagaatggcgatgtgattgattccgccaaccgaacaaatcaaagtgcggtcaaatttaaagctgatttgattatattcgatagtattggcgtgggggcgggagtaaaagctcactttaaacgcttgccaaaatctttacaagtggaaggatttaatgctggtggtgcagttgcttatcccgagcgtgaatatatcaaaggaaaaaagaatcaagatatgttttcgaacattaaagcccaatcttggtgggcgttgcgagatagattctataaaacctatcgagcagtaaagcatggggatgtttaccctgacgatgaactgataagcctatcgagcaatatcaaagagcttgagtatttgaaagcagaattatcacgtcctcgtgttgattatgacaataacgggcgggtaaaggttgaaagcaaaaaggatatgaaaaaacgtggcataccttctccaaatatggcggatgctttagtcatgtgctacgccacgacaaaacctaaatcactactggatttataa

SEQ ID NO: 2323 - DNA, 1335 bp, H. influenzae strain 86-028NP
atgaatattttagatggcatcaaatcacttgcgttaaagttaggcagcaaacaagaccagacatattatgctcgtgggcttagcttaaccgatgacttaatgcaaatcgaagcattatggcgtgataactggattgcaaataaggtttgtattaaacgttcggaagatatggtgcgtaattggcgcgatattttctcgaatgacttgaaatctgaacagctagacgagttcactaagctcgagcgcagattaaaactgcgtgagacattaactaaagcgttgcaatggtctagtttgtatggggcagtgggtttattacttgtcactgacacaattaacatcacttcgccattgcagcctacagaacgattaaagcggttgattatcttacctaaatggaaaatttcacctacaggacaacgagatgatgatgtgttttcgccaaactttggtcgatatagtgaatataccattattggcggcacacaatctgttttagtgcatcattcacgtttattaattatcaatgccaatgatgcacctttatctgataatgatgtttggggtgtgtcagactttgaaaagattattgatgtacttaaacgctttgatagtgcctcagcgaatgtcggcgaccttatttttgaaagtaaaatcgatattttcaaaattgcagggttatctgacaagatttcagctgggttagaaaatgatgtggctcacgttatttcagcggtgcagtcgattaaatcagcaaccaatagtctgttgcttgatgcggaaaatgagtacgaccgaaaagaattatcttttggtgggttaaaagatttattgacagagtttcgcaatgcggtggcaggtgcggcagatatgccagtcaccattttgtttgggcaatctgtttcgggattggcaagtggagatgaggatattcaaaactaccacgaatccattcatcgattgcaagaaacaagattgcgtcctgtgcttgaagtgcttgatacattactatgcaatgaattatttggtgggcaacctgatgactggtggtttgagtttttaccattgacggtggttaaacaagaacaacaagtcaatatgcttaatacctttgctacagcggcaaatacgttaattcaaaatggcgtagtaaatgaatatcaagtagcaaacgaactgcgcgaaagtggcttgtttgccaatatctccgctgaagacattgaggaaatgaaaaatgttaatgaatttgccggaaattttgaagagccagaaaacacggaagatgcgcaagttcaagccagtgaagatgagcaagagaacggagctttggtatag

SEQ ID NO: 2324 - DNA, 1182 bp, H. influenzae strain 86-028NP
atgaccgatgatgtagaaagagctatgcaacaaccgcaaggctctttttttatggatgatgcgaaagggttccaggcgattagtgcgaaagcgctgatgaaagtattagaaaagtacgaaaaatctgaccgcacttctcaagctgaaaatatcgccaatggcttcgttggtcgtggtgatgcacaaaaccatgctgaagtatcaaccaatttgaaaaaccaaactggcatcgatttatccgcttatttacgcaatagtccaaatattgctgaaagagtgaatgcattgaccgctggtaatatccagttaatcaagtctattcgctcgcaatatcttgataaagtgcaaaataccgtcatgcaagcaatggttcggggttctttaaataaagaccttgcagcacaagtaaaagacttaggtaaaacaaccgaaaaacgagcgatgtttattgctcgagaccagtcctcaaaattaaatgccgccttaacgcaagcgagacatgaagaggttggtataaaaaaatacatgtggtcaacatcgggtgatgagcgtgtgcgagaaagccatgcggaaaaagatgggcagatattcgaatatgccaatccgcctgccgatactggtcaccctggtcatgatgttaattgtcgatgcgttcagattccagtgcttgatgatgtagttaacttaaaatcagaagaaaccgaattaagctaccaggccgcagaacctaataagacagggaaaatggatctcgatgagttatttgaaagctctatcggtggaggtggtaataagtcattttctaactttggtggggttaattctgaattaattacgttagcgaaagagagtattggtttggatattacagattggcaacacagtattgatgaatcaagcatccgacacatattgaaacaacatggaaacgaaaaagcggaaaataaacgagggcaaagagccgttacaaaaaaagacattttattattgcctttggttgtctccgcatttgatagcattgagtacactgggacaagcgattcagggaatgaaacgtttttgattaaaaaagagattgatgacgaaatattcagcgtgcaggaagttaggaagagacacaagaagattgcagttaaaacaatgtggattaaaaggaaaaagaaagccacaagctccgcatag

SEQ ID NO: 2325 - DNA, 177 bp, H. influenzae strain 86-028NP
atgaaatttacagacaaaaccactcaagcagctacacaaagaaccatcactaaagatggttttttagttgtgcccgcaaccatttctaaagttggggtatttgattaccttgctacagaactaggcttaaaagaagacggcattaaaaaggtcgctcgcacagagaaatcattgtaa

SEQ ID NO: 2326 - DNA, 1020 bp, H. influenzae strain 86-028NP
atgtatcaattattccgtcacggcattttccaaatggatgctgaaaaggctcatgatttcacgattcaatgcttgaaattagccagtaatcctttatttcaaccgatcttaaaatctcttattcatgctcccaaaggctttccgaaaacggtaatgggtgtaaattttcctaatcccattggattggcggcaggggcagacaaaaatggcgatgcgattgacggctttggtacattgggtttcggttttctcgaggtaggaacagtcacgcccgttgcacaagatgggaatgcaaagccacgtcagtttcgtttgattgaagctgaaggcattattaaccgtaatggttttaataataatggtattgactatcttatagaaaatgtgaaaaacgcccgttataaaggtgtgataggcatcaatattggtaagaataaatttacatctttggaacaaggcaaagatgattatattttctgtttgaacaaagcctataactacgcaggttatattacggtgaatatttcatctcccaatacaccagatttgcgtcaattacaatatggtgattatttcgatgatttattgcgaagcattaaggatcgtcaggctattttggcaaaccaatacaataaatatgtgccgattgcggtaaaaattgcaccagatttaacggaaagtgaattagtgcaaattgcggatacattggttcgtcataaaatggatggcgttattgcaacgaataccacggtttctcgtgatacggttatggggatgaaaaatgccgaacagcaaggcggattaagtggaaagccgttgcagcataaaagcacggagattattaagcgattacatcaagaactgaaaggtcagattccgattattggtagcggcggcattgatgggttgcaaaatgcacaagagaaaattgaggctggtgcagagttgttgcaagtttattcaggattgatttatcacggtccaaaattagtaaaagaattagtaaaaaatattaaataa

SEQ ID NO: 2327 - DNA, 825 bp, H. influenzae strain 86-028NP
atgacaaaaaaatacgatttacattgtcatagtaccgcatcagatggagtgttgagtccaactgaattagtgcatcgtgcttatgcgcaaggtgtgaacgtgctggcattatgcgatcacgatacgattgtgggtattgatgaagctgagattacagcgaaagaagtaggcattgaattgattactggagtagaaatttcgacaaattgggaagggcgagggatccatattgtaggattaaacttcgataaaactcatccaaaaatgaccgcacttttgcaaagtcaaaaagcattacgggaaaaaagagcggtggaaattggcgataaattagaaaaagcagggattcctcatgcttatgacggggcaaaagccttagccgatggcgaagtgacgcgtgctcattatgcacgttatttggtgcagattggtaaggtatctaatgatggtcaggcctttaaacgctatttagggcaaggaaaatcagcatttgttaaagctgaatgggctgatattcccacggcgattgagacaatccatgccgcaggcggtatagctattattgcacatccattacgttataacatgacggggaaatgggtgcgtaagctgatagtcgattttaaggcttggggcggtgatggaatggaaatggcggattgtggtcaaacaaaagatcagcgtcaaatgcttgctcgttgggcaaaagaatttaatctgctgggatccgttggctccgattttcatttcccttgtggctggattgagttaggaaaaaatttagatttagttgatagcgttatcccagtttgggaaaaattttag

SEQ ID NO: 2328 - DNA, 609 bp, H. influenzae strain 86-028NP
atgaaaatgaaatccctttttgtggcaatgataacgtttttttctgccgcaccttttgctcattggcaacccatcggaaatgccgaatacacttgggggccgttccatgtttataccattggtttgttttctgaaactggcacttatcaagaaaatgaacgtccattaatgctctctttcaaatatgaaaaacccattgaaggaaaaaattttgcgattacgctcattaaagaaatcgaaaccttaaaacttaatgatggcgatactcaaagctggcttaaagaaatgcaagcgacctttcctgatttctcaccaaacgatattttgaactatattgccttacccgatagaggctacttcgtcttaaatgatacagttttagaacacgattttgatgctaaatttaatcaagcatttatcggcatttggcttgcaccgaatagtacttttgtaaaacttcagccacaattattaggcaaaacgaaaagcaatcatgaagcgacagagttttatctcaaacctgaaattgaatcctttgatgaacaagattctacacctgaattaccgccaaattatttattagatagtcagaaaaaatctcaaggataa

SEQ ID NO: 2329 - DNA, 1395 bp, H. influenzae strain 86-028NP
atggcatttcgtattgaaaaagacacaatgggtgaagttcaagttccagcagataaatactgggctgcacaaactgaacgttcacgcaataactttaaaattggcccagccgcatcaatgccacatgaaattatcgaagcttttggctatttgaaaaaagcagccgcatttgctaatcatgatttaggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgcgcacatgtgataaacggtggaaaattaggtgaaaaatctattattcacccaaatgacgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaatacgctgccacatttaagccaattagcattgggtggaactgcggttggcacaggtttgaatacgccgaaaggctatgatgttaaagtggcagattacattgcaaaattcaccacacttccgtttgtcactgcagataataaatttgaagcattagccgctcatgatgcgattgttgaaactcacggtgcattacgtcaattagcaatgagtttatttaaaattgcgaacgatattcgtctattagcatcaggccctcgttcgggaattggcgaaattttaattcctgaaaatgaaccaggttcttcaattatgccaggtaaagtaaacccaactcaatgcgaagcgatgacaatggtctgtgcacaagtatttggtaatgacactacaatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgctggtgaccgcacttaatacgaatatcggttatgaaaatgcagctaaaattgcaaaaaccgcacacaaaaatggcaccacattacgtgaagaagcgattaatttaggtttagtgtctgccgaagattttgataaatgggttcgcccagaagatatggtgggtagcttaaaataa

SEQ ID NO: 2330 - DNA, 939 bp, H. influenzae strain 86-028NP
atgaacattgtatttacactagattgtaattttgctagtcacttagacaccgtactaaaatccctttgctaccatcataataacatcaatatttatgtaatacacgatggtattcctgctgaaagtttagaaaaattaaaaatgcattgtgctaaatttgataacacactgtacgatattcaatttaatattaatcaattctcatttccaactgtaatatctcctgctcacatccaaagcactgcttcattattccgtttatatcttcatcaaattttacctcagcatattgaacgagttatttatcttgatatggatcttattattcatcaggctatagacgaattatgggatattaatttagaagatagcttaattgcgggtgtgagtgactttttttctgaatatttatgggaacatccattttatgaaaaacagcaatatattaatgcgggagtgatgttaattaatctaaataaatggcgagaaaataacattgagcagtattttattgagtacgctgccaaatatggtgaattttttgtgtatggagatcaagatgttattaattttagcatacctacgaatttgattaaattattacctgtaaaatttaatattcaggttaaatttattgaatatttatggatggaacataaagagaaaataaaatttactccgcatattattcactacattggtagcaacaaaccttggttaaaggaacattcagctaactctcctcgtttttataatgaagaatacttgttttatcatcatctttcttgggataatcttagacagacagacagacagacagacagacagacagacagacagacagacagacagacagaaaaatataacccaattgccttgtatgtcaaagtgcggttaattttgaccgcattttttcttttggaaggaaaattacattga

SEQ ID NO: 2331 - DNA, 345 bp, H. influenzae strain 86-028NP
gtgttaggcgtttgtagtgcgctttcggatatgccagttgttgtcccaacggtaaatgaatcacagcttttagaactaagacaacgtaacattgttagtttgccttatccataaataagccaacttgctttaacccttgcccctattttacaagggactaatcttaatcaaatgtttgttacctctttattgccagcgtcttatacaggtgtggaaaccgtaactaaacttgctggacaaacagcccatttattaaacagtattccattagacgaagaagatactcgctttgcatttgatgtctatccgcatcaaacaccctgtttatctaatcaattacaatga

SEQ ID NO: 2332 - DNA, 435 bp, H. influenzae strain 86-028NP
atggcaaaaactgcacaattttatattcttacggaaaattgtactttaactgtcgaagaaatagcctgtaatcttgctgcttcaatatggcgttcagggaaaaaagtactaattagttgcgaaagtgagagccaagcattagaaattgatgaacttttgtggcaacgagatcccaatgaatttgttccgcataatttatcaggtgaggcaacacaatatcccacaccgattgagatttcgtggcttggaaaacgaaatttacaacaccgcgatttgttaatcaatttgcaacaagaaatcccagattttagccatagttttacccaaattattgattttgtgccgaaagatgatgcgttaaaaacacaagctcgagaacgttataaacaattacgtctgcaaggttggaatctttctactgaaaacgtgggttaa

SEQ ID NO: 2333 - DNA, 171 bp, H. influenzae strain 86-028NP
atgactgaacgtgagaaaattattcaacaacagaaacaacttaaagcgttattttcagtttggatgaaagagaaaatgaatcacgaggtggttatctttcaaaaaactgatggcaagatagtcgagcattatctggatggttcggaaaaaattgtgggttatgcaaaataa

SEQ ID NO: 2334 - DNA, 375 bp, H. influenzae strain 86-028NP
ttgtggaaaaatggttcgggaaaaagtactttacgttcttttaaccaagatgctgtgcaaattgtgattgattctgatcatattgcaatgcagattaatcctcaaaatccaagacttgctgatattgatgcaggcagaaaagcgatagggctatttcgttttgctattaagctacatattgatttttctatggaatcaacgctttcgggcaattcaattattcagagaataaagaacgctaaagaaaatggtttctatgtacatttaaattatattggtattaatcgcattgaaataaatcttgcacggattaaggcaagagtaaaaagtggtggtcattttattgctgaagatattgtaaaatatcgttattaa

SEQ ID NO: 2335 - DNA, 168 bp, H. influenzae strain 86-028NP
ttgtcatattgtgatgaaatttttatttatgataattctagcattgcgcctgaattgatttttcaactaaaagataactgtattactcaatttagtgaatttttaccaagttggtgtgaaaaaatattgaataatttgagaaatctaggatttgaaaaaattttctaa

SEQ ID NO: 2336 - DNA, 315 bp, H. influenzae strain 86-028NP
atgcaaccaaacgaaatcactttttaccaacgttttgaagccgatattctcgctgggcgtaaaaccatcaccattcgggacaaatccgaaagccattttaaagcaggcgatattttgcgtgttggtagatttgaagataatcaatatttctgcaccattgaagtgttaagtgtatcgccgattactcttgatgaactgacggaacagcatgcgaagcaggagaatatggggttggataagctgaaagaagtgattaaaacaatttatccaaatgaacatgagtcttggataattaattttaaacttattgggtag

SEQ ID NO: 2337 - DNA, 402 bp, H. influenzae strain 86-028NP
atgaatttttcttatattttagaacaacttaaaagttttactattgaggacgttattctcaaaatctgttattttgttatctcaattatcgtaggtaaagtttcacggcaatgttggaagctgattagaatatacgttaatgaatgtagaacgattagagagctttctgaatcagataaagaatttattcaaaataataattttgaatttgaagtcgataaggaaaatgaataccaaaatttagaagagctaaagcggaaaggattagtaaatattgagttttgtgaggatgaattacaagatgcctcaggaatttatttatgtactgtaacaaataaaaatagattaaaaatttcattaacgaaatttggaaaacaaataaaatatcttatagaaaaataa

SEQ ID NO: 2338 - DNA, 2865 bp, H. influenzae strain 86-028NP
atgacacaaaaattcgaaatggcagaccgttttaatccgtctgcggtagaacaagccctttatcaacattgggaagagagcggttattttaaaccgtctgaaaatgaaaatgcgccgagctattgcattgcaattccgccgccgaacgtaacaggttctttacatatgggacacgcattccaacaaaccttaatggataccttaatccgttttaaccgtatggaagggcataacaccttatggcaagcggggacagaccacgcaggtattgcaacccaaatggtggtggaacgtaaaattgcggctgaagaaggcaaaactcgccacgattatggtcgtgaagcgttcatcaacaaaatttgggattggaaagcttattcaggtggcacaatcagccaacaaatgcgccgtttagggaactcaatcgactgggaacgtgagcgtttcaccatggacgatggtttatcgaatgcagtaaaagaagtgtttgttcgtttgcacgaagaaggtttgatttaccgtggcaaacgcttagtaaactgggatccaaaacttcacaccgcaatttctgatttagaagtagaaaacaaagagagcaaaggctccctttggcatttccgttatccgttagcaaacggtgcaaaaacggcagatggtaaagattatttagtggtggcaaccacccgtccagaaaccatgttgggcgatacggctgttgcagtgcatcctgaagatgagcgttatcaatctttaattggtaaaactgttgttctaccactggctaatcgtgaaattccgattattgccgatgaatatgtggatcgtgaattcggtacaggtgtcgtgaaaatcaccccagcacacgatttcaacgactacgaagtgggtaaacgtcataacttaccaatggtaaatgtattgacgctgaacgcaaatattcgtgatgaagcggaaattatcggtactgacggcaaaccacttgctggctatgaagcgacaattcctgcggattaccgtggcttagaacgttttgctgcgcgtaagaaaattgtcgcagattttgaagcactgggtttattagacgaaattaaaccacacgatttgaaagtgccttatggcgaccgtggcggtgtgccaatcgagccgatgctaactgaccaatggtatgtgagcgtgaaaccgcttgctgatgtagcaatcaaagcggtagaagacggcgaaatccaattcgtgccgaaacaatatgaaaacctttacttctcttggatgcgtgatattcaagattggtgtatttctcgccaactttggtggggacaccgtattccagcgtggtatgacgcagaaggtaacgtttatgtcgcgcgtaacgaagaagaagtgcggtcaaaatacaacttagattctgcggttgaactcaaacaagatgaagatgtgttagacacatggttctcatcaggcttatggacgttctctaccttaggttggccagagcaaaccaaagagctcaaaatgttccatccaacggatgtgttaatcacaggcttcgacatcatcttcttctgggttgcgcgtatgattatgtttacgatgcactttgtgaaagatgaaaatggcaaacctcaagtgccattcaaaactgtgtatgtaacaggcttgatccgtgatgagcaaggtcaaaaaatgtcgaaatcgaaaggtaacgtacttgatccaatcgatatgattgacggtatcagccttgaagatttacttgaaaaacgcactggcaacatgatgcagccgcaattagcagagaaaattgccaaagcaacccgtaaagaatttgcggacggcattgctgctcacggtacagacgcattgcgttttacattagcggcgttggcttcaaatggtcgtgatatcaactgggatatgaaacgtttagaaggttaccgtaacttctgtaacaaattgtggaatgcaagccgtttcgtcttaacgaatgaaaaattagatttaagtgaaggcgagatcgaattctcattagcggatcgttggattcaatcggaattcaatcgcacagtggaaacgttccgtaattcattaagccaatatcgttttgacctttgtgctaatgcaatttatgaatttacctggaaccaattctgcgactggtatttagaattgactaaaccagtatttgccaacggcaacgcagcacaaatccgtgcagcaagccaaaccttggttcacgtgttagaaaaattattacgtttagcacatccgcttattccatttattactgaagaaatttggcaaaaagtgaaaggttttgtcggcattacggctgacagcattatgttgcaacctttcccacaagtggaagagaacggctttgatctagaagcagaagctgaaattgagtggttaaaagaagtgatcgttgcggtacgtaatatccgtgcagaaagcaacatcgcaccaagtaaaggcttagatctgttattccgtaatttaagcgcagagaatgcaaagattcttgaaaaacagaccgctcttttgaaagcaatggctaaattagataacgttcaagtgttagctgcaaacgaagcagcaccgcttgcggtagcgaaactcgttggcaatgcggaattactcgtgccaatggctggctttatcaataaagaagcagagcttgcccgtttaaccaaagagattgaaaaatatcaaaacgaagttaaacgcatcgagaataaacttagcaatgaatcttttgtggctaaagcacctgaagcagtgattgcgaaagaacgagaaaaacaagcggaataccaatctggattagaaaaaatccaagagcagtataaggcgattgaggcattgtaa

SEQ ID NO: 2339 - DNA, 108 bp, H. influenzae strain 86-028NP
atgagtgttattgatgaagatgaagccaagaaaacccaagaggctctgatcacaatgagccaactcgaacacgaagttggagattttttaggattaaatcaaaaataa

SEQ ID NO: 2340 - DNA, 1434 bp, H. influenzae strain 86-028NP
atgatgatcactcaagattttaccaaacccattgattccgctacggtgctacaaaaaatcgtgcttgataaagcacaatgggttaaagcaaaagaaaaggaatttcccctttcacaatttaaacaaaacattcaaaactctgaccgctctttttatgatgcgttagcaaaaggtacgcatcaaaagcccgcttacattttggaatgtaaaaaagcctccccttctaagggattaattcgtgctgaatttaatttggaagaaatcgccaatgtctataaacattatgcctctgctgtatctgttctgacagatgaaaaatacttccaaggcaattttgagttcttgccgttagttcgcggtatcgtgagccaacctgtgctttgcaaagattttatgattagcgaatatcaagtttaccttgctcgctactatcaagcggatgcgattttattaatgctttctgtggtaaatgatgaaacttatcgtgtgctggcagagcttgcacattctcttggcatgggcgtattgacagaaaccagcaatgaagaagaatttgaacgcgcccttgcgcttggtgcgaaaatcattggtgttaataatcgtaacttgcacgatttaactgtggatttaaatcgtgttgttaaactcactgaaaaatacgccgaccgaatccctgctgatgtacgtattattagcgaatcaggcatttacaatcacaagcaaattcatcaattacaaaaggtggcgcatggtttcttaattgggagtagcttaatgggcaaccaagatttgaataatgcggttcgctcggtgatttttggagaaaataaagtatgcggtttaacacgcacgcaagatgtcaaaatcgtttacgaaaacggggcactttacggcggattaatcttcgtagaacattcaaaacgttgtgtgagtttacgccaagcgcaagaattagtaaccgctgcgccacttcgatttgttggtgtttttcagaatcaagaaattgactttatcgtcaaaatagccaaccagttgcagctttatgcggtgcaattacatggtgcagaaactgaagcatttattaccgcacttcgccagcaactaccaaaaaacacgcaaatctggaaagcgatttcggtcaatactgaagcccaaagtacggtcgattttaccgatgatttgaatgtggatcgttatatttttgacagccagacagcgaaccaacaaggcggcacgggtaaaacctttgattggtcattaattcccgaacatcttaagcacaagattattttagctggaggtatctcgccaaataatgtagaacaagccattcaacaaaattgcttaggcttggatcttaattcaggagtagaaagttctgtgggcgtaaaagatcaagaaaaagtacggttagtttttaataatatttattaa

SEQ ID NO: 2341 - DNA, 1002 bp, H. influenzae strain 86-028NP
atgcaacacaaccaattattagagcaactttatagcggacattcactttcaacctcagaaagcaccgcactttttaatgcagtcatccaaggtgagctttccaatgaacaaattgctgcaatgcttattgctttaaaagtgcgggaagcaaatactgaggaaattacgggtgcggttgccgcctcattacaaaatgccaaagtatttccacgtccagattatccttttgcggatattgtaggaacgggtggtgatggacaaaacaccattaatatttccacagccagtgcgattgttgcggcatcaatgggagcaaaagtggcaaaacatggcaatcgtagcgtgtcgagtaaatcaggtgctagcgatgtgcttaccgcacttggcgttaatgtgaacgtcacaccagagcaagctcgacaagcattagatgaaattggtgtctgttttttatttgctcaacaatatcattctggcttccgtcatgttgcaccagtccgtaccgctttaaaaacgcacactatatttaatattttagggccgcttatcaatcctgctcgcccaacttatcatttacttggcgtatatgcgcctgaattagtaaaaacctatgctgaaaccgcagttgccttagaacatcaacattcctttgttgtacatggttctggcttagatgaagtcgcattgcacggcgaaacacaagtggcagaaattaaaaatggcaaaattgaatatttcactttaacgcctgaagattttggcttaaaaacgcaatccctcgaaagtcttcgcggtggtgaaccacaagaaaatacccaatatctgaccgcacttttacaaggcaaaggaaaggctgaacatgctaatgcggtggctgcaaatacggcattattattgaaattattcggttacgatgatttaaaacaaaatgtgcaaaatgtattggcgcatcttgcatcaggtaacgcctttaaaacattacagaaattaaccacatattaa

SEQ ID NO: 2342 - DNA, 387 bp, H. influenzae strain 86-028NP
atgatcaccgtattcggacttaaatccaaactcgcaccacgtcgtgaacaactcgcggaagtaatttataacagtcttcatctcggattagacattccaaaaggcaagcacgcgattcgctttttgtgtttagaaaaagaagatttttactacccttttgatcgtagcgatgattacaccgtcatcgaaattaacctgatggctggtcgtatggaaggtacaaaaaaacgcttgataaaaatgctatttagcgaattagagtacaaactcggtattcgagctcacgatgtggaaattacgattaaagaacaaccggcacattgctggggtttccgaggaatgacaggcgatgaggcacgcgatttagattacgatatttatgtttaa

SEQ ID NO: 2343 - DNA, 588 bp, H. influenzae strain 86-028NP
atggctaatattttatttttagataacttcgattccttcacttacaatcttgtggatcaatttcgtgtattaggtcacaacgtcacaatttatcgtaatgactgcgacttagaaaaactggtagaaaccgcactcaatatcaatacacttgataccattcttgcactttctccagggccaggaacaccatcagaagcggggattttactgccattgatcgaacgcttaaaaaatcaagtgccgattattggaatttgtttaggccatcaagcgttgattcaagcctttggtggtaaggttgttcacgctggcgaagtgttgcatggtaaagtttctcgtatatcccatgataacgaagctatgtttaaagatcttgctaatccaatgcctgcggcgcgttatcattctttaatgggacaagatttaccaaaagaatttatcgtcaatgcggaatataatggcattatcatggcaattcgtcatcgtgatttacccatttgcgcattccaatttcaccctgaaagtattttaactgtgcaaggttcgcaattattacaacaatcaattgaatggttgttaaatagataa

SEQ ID NO: 2344 - DNA, 1557 bp, H. influenzae strain 86-028NP
atgaacattcaaactcaagcctttattgcggtgacagctcaatcaattccctattatgctgataccaccgctatttttaatacactttgccaacctaattcaaattctcttctactcgactctgccgaaatagggagtaaaaatagtttacaaagtcttattttagttaatgctgcggttaaaataacgtgcttaggtcacaacgtcacatttaaagctttaaataagaatggaaaacaagttttaaaagaaattcatccaaaattaaccgcacttggaaaaataagtgcggtcaattttgaagacgaattttctgtacaattttcgccacttgataatcaactcgatgaagataataaattacagtctgctactatttttgatgggttgcgtgttgtttctactctttatcaacatagccaaacgcctatttttttaggcggattatttgcttacgatctcgtcgcaaatttcattccaatggatggcattacattaaaaaatgatggtatcaactgccctgattacagtttctatcttgccgaacacttaattactatcgaccatcaaaatcaacaagcgacacttaaaagtttctgttttgctcaagaagaacaagtcaatattgcgaaaacctcgctttctatcgcacaaaaactaaaaaatattgatcacgttctttctattaaatcggcaagtgatgaagttaaaacaaactttgacgatcctgaatttactggtatcgtaaaagccttaaaacaccatattaatattggagatgttttccaaattgtgccttctcgtcgtttttcccttgcttgccctaatacattagccagttatgctcaactcaaacaaaataatccaagcccttatatgttctatatgaatgatgaagactttattttgtttggtgcatcgccagaaagtgcgctgaaatatgcgccagaaaatcgtcagttagaaatttacccaatcgcaggttcacgccctcgtggttttgatgctcacggcaacattgatcctgaattagatgcacgtttagaactggaacttcgtcttgatcataaagaacaagcggaacatttaatgttagttgatttagcgcgtaacgacattgctcgagtttgccaaaatggtacccgtaaagtggcagaattaatgcaagtggatcgctattctcacattatgcatttagtgtctcgtgtggtgggtaaattacgccctgaattagatgcacttcacgcctatcaagcctgtatgaatatgggcacattaactggtgcaccaaaaattaaagcgatgcagcttatttatcaatttgagcaacaaaaacgccatagttacggtggtgcggtgggttatctcacgtctgatggacattttgatacctgtatcgtgattcgttctgctttcgtacaaaatgggatagcccatgtacaagcaggttgcggtgaagtattggattctgatccacaaatggaagccgatgaaacacgccataaagcagcggctgtcttaaaagcaattcgtcaagttaatacacaagcaaaataa

SEQ ID NO: 2345 - DNA, 911 bp, H. influenzae strain 86-028NP
atgaaaaggatttatactgatgaaccaaccaaccaaccaaccaaccaaccaaccaaccaaccaaccaaccaaccaaccaaccaaccaaccaaaataataaaaccgttgcggtagtaacttcaacaataggtcgtccagaattatctttggctattaaaagcgtacaaaatcaaacttatccatgtaagcattatgtatttgttgatggcaatattttctgggataaagccaaatctatattggaacaatttcctgatgtaattcctatttatttgccaatgaatacaggaaaaaatggaatacttaacggtgcaattaacgcagtagcagcttttcttgttgaagaagacattatttgttatttagatgatgacaatcagctacgagaagatcacgtggaaagcttagtaaacgtgattgagcaaggtgctgattttgcttattccttgcgatctttttacgattcaaatcatcaatttatttgcaatgatgattttgactctctcggaaattggaatacaaaaagcgatattttcgtagatgttaaaatagaagatattcagaaacaaatacattttacttttaatgaagttaatggacatattgatactaattgttacgccgtacctcgtgagattgcacaaaaaacttcatatagttggaacacaccattaattggtgatcgcagctttttatctgccttaaaaagtttggggttaataggtcaaacttcaggaaaatataccgttaaatacagagctgatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataa

SEQ ID NO: 2346 - DNA, 498 bp, H. influenzae strain 86-028NP
atgttatcagaaaatgtagtaaaactattaaacgatcaaatgaatttagagttttattcttctaatttatatttacaaatgagtgcttggtgcgatcagcaaggctttgaaggcactgcaaaattcttatcagttcatgctgctgaagaaatgcaacatatgcgtaaattatttacttatttaaatgaaactggctcacttgctgtaatttctgcaattgaagcacctgcacatgaatataaatcattaaaagaagtaattgaagctacctatgagcatgaaaaattaattaccagtaaaatcaatgaattagtaggtaaaacctttgaagaaaaagactactctgcatttaatttcttacaatggtatgtggaagaacaacatgaagaagaaaaattatttagtagtattttagataaattaaattttcttggagaagatggcaaaggcttgttcctaattgataaggatttaggtaatctctctactaaagcctaa

SEQ ID NO: 2347 - DNA, 549 bp, H. influenzae strain 86-028NP
atgattgccgcaaattacgctttattgcattttatcaatcaaaatggaaaggaattagttatgcttaatcaaataatcataaacaagctgaacgaccaaattaacttagagttctactcttctaatgtttatttacaaatgagtgcatggtgttcaaaacacggttatgagggggctgctaccttcttacttcgtcatgctgatgaagaattagaacatatgcaaaaactgtttaattatgtaagtgaaactagtggtatgcctattttaggaaaaattgatgcacctaaacatgattattcttcattaagagaagtttttgaaataactttagaacatgaaaaattagtcacgtcaaaaatcaatgaattagttgaagttacttttgaaagcaaagactactctacttttaacttcctgcagtggtatgtagcagaacagcatgaagaagaaaaattatttagtggaattattgatagatttaatcttgttggcgaagatggtaaaggattattctttattgatcgtgaactcgcaactttggaatag

SEQ ID NO: 2348 - DNA, 1020 bp, H. influenzae strain 86-028NP
atgtttatgcataaaatgaaaaaaaatcttattatcgttttaaccttaggtacgttaccttttgctcaagctaatagcatcactggtgctggagcgtctttcccttatccaatttatgcgaagtgggcatctttatatgagaaagaaactgggaataaagttaattatcaatccatcggttcgggcggcggacaacagcaaattattgcaaaaacggttgattttggtgcctctgacgatccaatgaaatccgaattattacaacaacaccaactagtccaattccctgcggttatcggtggtatagtgcctgttgttaatttgcctgaaattaaacctggtaaattaaagttatcaggtaagctgttagcagaaatcttccttggtaagattaaaaaatggaacgatcctgacttagttgcattaaatccaacgcttcctttaccaaataaaaacattattgtgattcatcgttcagacggctctggaacaacatttggcttcactaattatctatctaaagtttcgaacgattggaaaaatcaagttggtgaaggtaaatcagtgaagtggttaacaggtcaaggtggaaaggggaatgagggagttgcttcttatgttcgccaaatgaaatacagcattggttatgtagagtatgcctatgccaaacaaaatcagcttgcttggatttcattacaaaatcaagcagggcaatttgtacagccttctaatgaaagtttcatggcagctgcaagtcacgcaaaatggcacgaaaaggcaggaatgggtgttatattaaccaatgaaacgggggaaaaatcttggccaattacggcggcgagttttattttattaaataaatattctgacaatcctgaaacaactaaaaatgtattagccttttttgattgggcattctcaagagggcaagatgcggcaactgaattagattatgtgccaattccagctgatgtggtgtctaccattaaaagtcaatggaaaacagagctaaaacaataa

SEQ ID NO: 2349 - DNA, 948 bp, H. influenzae strain 86-028NP
atgctcacaaaaagtcggaaatattttaatcaaacatggattgaatcattattcaaacagactacggcattgtttgctttgcttgtgtttattttacttgctgctattttaatttctttagtcataggaagctgggaaagtattaaacgttttggtgggagttttctattagaaacatattgggatcctgtacaagaacaatatggggcaattattcctattttaggtacgcttattacggcgggtatcgcattatttatcgcagtacccatttcatttggtattgctatttttttaacggagctagctcccaattggctaaaacgtcctataagcattgcaattgaaatgctagctgcaattccttctattatttacggaatgtgggggttgtttgttttcgttccattatttcaagaacatattcagccagtactaattgacaatttggggaatttacctggattagaattatttttttctggcgtaccttttggtgttggtttatttacggcaggattagtgcttgccataatgatcattccttttattgcatccgtaatgcgggatgtctttagtatagtaccaccaatgttaaaagaaggtgcttatggattaggtgcaaccacttgggaagtggttcgacaagtgattgtaccacacactagaatagggcttgttgggagtgtgatgctaggattgggaagagcattgggcgaaacaatggctatcacttttattataggtaattcgtttcaattgcctaattccttattttcaccttctacctcaatcgcatctgctattgctaacgaatttaatgaagcaggtggattacaaaaatctgcattgatggaattaggattacttctctttgttatcacaactatggtattgattttatcaagattaatgattacaaaaatgcaacaaacaaaagggaaataa

SEQ ID NO: 2350 - DNA, 849 bp, H. influenzae strain 86-028NP
atgaaaactaatcaaaacttgcgtttttattggcgtaaaacacacaataaattaatgttagggctttcctatatttcagtcattatcggcttattttggttgtgttggatattattcactctaattaccaaaggcattccagctttatcaattgatttattcacacaatctacccctgcccctaatgaaaaagggggattgttaaatgcactgattggttcgttttttattgtcggtgcgggtacattgataggcacgcctataggggtattggcaggaacgtatttggcagaatatggtcgttatagccgtttcgcacaaattacccgttttcttaatgatattcttctttctgccccttctattattattggtttgtttgtttacagcttatatgtatcaaaaatcgagcatttttcagggtgggctggagcattcgcattagctttattgcttattcctatcgtggtacgcactacggacaatatgttattacttgtaccaaataatttacgtgaagcagcggcagctcttggttgctctcaatggcaagttattatgatgatttgttatcgagcagctaaatcagggattttaactggcgtgctattagcagttgcccgaatttcaggagaaactgcaccgctattatttaccgctctgtctaatcaatttctatcttggaatatgaatgaacctatcgcaaatttacctgtagttatttatcaatatgcagcaagtccttttacagattggaataatctagcttgggcaggtgcagctctaataacattatttgtgctttgcttaaacattttcactcgactcttctttcaacataaaaaataa

SEQ ID NO: 2351 - DNA, 768 bp, H. influenzae strain 86-028NP
atgattagtctacaagaaaccaaaatagctgtgcaaaatctaaatttctactatgaggattttcatgcattaaaaaacattaatttacgtatcgctaagaataaagtgaccgcctttattggtccttcaggttgcggtaaatctactttattgcggagttttaatcggatgtttgaactatatccaaatcaaaaagctactggtgaaattaatttagacggtgaaaatttactcacaacaaagatggatatttctctgattcgtgctaaggttggtatggttttccaaaaaccaacgccatttccaatgtcgatttatgataatattgcattcggtgttcgtttgtttgaaaaattatcaaaagaaaagatgaatgaacgagtagaatgggcattgactaaggccgctctttggaatgaagtgaaagataaattacataaaagcggagatagtttatctggcggacaacagcaacgcttgtgcattgctcgagggattgctattaaacctagtgtgttgttgttagatgaaccttgttcggcattagatcctatttcgactatgaaaattgaagaactcattacggagttaaaacaagattatactgtggttatagtaactcataatatgcaacaagctacacgttgctccgactatacggcattcatgtatttgggtgaattagttgaatttggtcaaacacaacaaatttttgatagacccaagatacaacgtacagaagattatattcgcggtaaaatggggtag

SEQ ID NO: 2352 - DNA, 696 bp, H. influenzae strain 86-028NP
atgacgagaaaaattctgatagttgaagatgaatgtgcaatccgtgaaatgatcgcactgtttttatctcaaaaatactatgatgtgattgaagcgagcgatttcaaaacagcgataaacaagataaaagaaaatcctaaactaatattattggattggatgctacctggtcgttcaggtatacaatttatacagtatattaaaaagcaagaaagctatgctgcgattcccattattatgcttacagctaaaagtacagaagaagattgtattgcctgtttaaatgcaggggctgatgactacatcactaaacccttttcacctcaaattttattagctcgcattgaggcagtatggaggagaatttatgaacaacaaagtcaatttatacaaatcgatgaactttccattgatgaaaatgctcagagagtgtttttccaacagcaggaaattaatttaagtagtacagaatttaaattgttacatttttttatgaggcaccctgaaaaagtttattctagagaacaattgttaaatcgtatttggcataatgatctagaagttgaatatcgcactgttgatagctatattcgccgtttacgccgtaatttagctccttttcaatgtgaacattatatccaaacagttcgaggatctggttatcgattttctagttatttacgagataaacaatga

SEQ ID NO: 2353 - DNA, 1278 bp, H. influenzae strain 86-028NP
atgaaaaaaatattgaattttattgttgaaataaatttggcaatcattatttccttatttacttctgattttattctttggtttgcaataatacttttattaattttagcttggcatcatattaatgaatatcgtttactcaaatatctcaatttaaagcaagataataaattctctttattacaattaggaacattctctcaaactgaagcctaccatcgtcatcaaatttacaaagaaaaatgtgcaagtttacgtttgttatctcaaataaataaaaatattaagtatttaccagatgcaattattatctgtcagcataatggtaatatttcttggtgtaattcaattgcgcaacagatgtttgatttttgttggaataaaaaagtccagaaaaatatttttgatgttattttttatgaacaatttaaacattattttttcagtcaaaaaaaaagacgaccgttagtactattaacttataatcaacgttatattgaggtgcagtcgcacgcttataattctcatatgattttagttatcgctcgagatattacagatatgattcatttacttaattcacgccaaaaattcttgagtaatattaatcacgagctacgtactccattaaccgtattacaaggttacttagaaattcttgcagataataatattcagaaccctctacaaaaaaaggctatttttgcaatgcaagagcaaagccaacgaatggaacatctattacaacaatttaattttttagcaaaaatagaaacaacttcagataaggattttcgtaaatttgatatgtcagccatgataaattctttaagaaaagatacagatatattaaatacttataatcatcatattgaatttattattcagcctaatatcattatttttggaaatgaatctcaactaagaagtgccgtttcaaatttaatttataatgctattaagcattctggtaaacagtgtcatattcaaattcaatgggaaacttgtgaacagggtattaaatttaacgtgatagataatggtgttggcatatcaccacagcatattccacatttaacagaacgtttttatagagttgatgaatctcgtagccatttaactggtggaagtggtttaggactagctattgtgaagcatactttattacaatatcattctcatttaaatattgaaagtactgaaacgaaggggagtagtttttcgtttatcatacctaaacgctttgtcatatcaaaaaataataaagaaattcaatga

SEQ ID NO: 2354 - DNA, 1422 bp, H. influenzae strain 86-028NP
atggcaaaagatttcagcttttttatttacgattatgaaagttttggtgtaaatccagcaacagatcgccctgcgcaatttgcgggtattcgtacagatgctgattttaatatcattggtaaaccaataatgttttattgtaaacaaaccaacgattatttaccggctcctgaagccgtaatggtcacaggaattacgcctcaagaatgtaatgaaaaggggctttcagagcctgaattcgccgcaaatatcttagcagaattttcccaacccaatacttgtgtcatgggttataacaatattcgctatgatgatgaaatgacgcgttatacgttttatcgtaattttattgatccttatgaatacagctggaaaaatgggaattcacgctgggatttgttagatttagtgcgagcctgttatgccttgcgtccagaaggaattaattgggcttatgacgatgatggaatgccaagtttccgcttagaaaaactcactaaagcaaatggtattgagcatgaaaatgctcacgatgccatggcggatgtatatgcaactattgctatggcgaaattaattaaagaaaaacagcctaaattattccaatatttctttgaaaatcgcggtaaaaaagaaatcgaaaaattagttgatacaggcgcaatgacacctttagtgcatgtttctggaatgctagggaattatcgtggaaattgcacttgggttgcacctttatcttggcatccgacaaatcaaaatgcattaattgtgtgtgatttaactggcgatatcgataatttattagccaaaagtgcggatgaattacggacagatttatataccaaaaaatctgaattagaagaaagaggagtttcatccgttccgttaaaacttgtgcatattaataaatgtcctattttagcaccagctaaaactttgttaccagaaacagcaaatcgattgggtattgatcgacaattatgcttggataatcttgcaaaattacgagcatcttttgatattcgtgaaaaagtggcggatatttttaatgaagaacgtcaatttgcatcgaatgataatgtagaaactgagttatacaatggcttttttagcaatgctgataaaaataatatggctattttacgtagtttacctgcagaaaaattatctgaacatggtttagcttttgaagataaacgtatccttgaattattgttccattatcgtgctcgccacttttataaaaccctcacacgcgctgaacaaattaaatggcaaaaataccgacagaataaacttgaaaaaagtgcggtagagtttcaatcaggtttacaacgtttagccgaggaacattcagataattctgaaaaactatctttgctacaacaagtatatgaatatggtataaaattactaggttag

SEQ ID NO: 2355 - DNA, 876 bp, H. influenzae strain 86-028NP
atgcacaatcttatttttgccattctttgcagcgtagcagtttcagttttactgaaaattgcccgtaaaaaaaatatcattattgaacaagctatcgcattcaactacattacagccatcactttcagttatttcttacttaaacctgattttaaaggcttagagtttactgattacattgcacaaagcgaaaattcacccatttttttagcactaggtttattgctacctagcgtatttattattatgtcaaaagcagtggagtttgctggaattgtacgttcagatgcagcgcaacgtctttcgttatttcttcccattttagcagcgtttttaatttttcatgaaacactaagccaatctaaaatcattggcgttgtattagcctttattggtttattttgtttattaactaagccaactcaagggcaaagtgcggtcaattttaaaggtgttttaggattaatcggcgtctggtttggttacggcatcattgatattttattcaaacaagtagcgaaaagcggtggtgcatttcctgcaacattgtttatttctttctcgcttgcagcttgcgttatgtttatctatttattcttaaaacgtgcgcaatggacatcatcaagtgtaattggcggcatcgttttaggtgtattgaatttctttaatattttattctatataaaagcacatcaaagttttgctggaaatccgacgcttgttttcgcgggaatgaatatcggggtaatttgcctaggtacgataactggcgcattagtttttaaagaaaaaatcagtaagctaaattggctaggtattatttttagtttatcggctattttctgcctatattatttagataaacttatcgcgtaa

SEQ ID NO: 2356 - DNA, 909 bp, H. influenzae strain 86-028NP
atgaaaatctttacatcaaaaaaaggacaattatcacagctgaagcagcaaaaatttaagctggaaaaggatattcagcgtttatttgaagaaaatcttaccttattaagtggctatatttttattcgctcagaattttctattaaaaattcgcgtattgataccttagcttttgatcctgaaactcaagcctttgtcattattgaatataaaagacaacaaaattctagtgtggttgatcaagggatttcttatcttaatttgatgcttgaatataaagctgattttattgtggaatataatgaaaagcaaaaagccccacttaaaagaaatgatgtggattggtcacaatctaaggtgatttttgtttcacctacttttaatgatttccaaattcaagccacaaattttaaagatttacctattgaattatgggaagttaatcgctttgataatgatattattacgctcaatattattaataaatcaaaatcagcaccgaatattaaagctgtttctattgaaaaaaatgaagaattttctacattaaaagaaataaaagtttatcaagaatctgatcacttaagtgataaatcagattttattcaagaactatacgaagattttaaacaaggcattttaaatttagatcctaatatcgaaattaatactagaaaactttacattgcattcaaaaaagatcgaaatattgcagatattcgtatccaacaaaagaatttaaaaatttggattaatcttccttatggagagttagacgatcctaaaaatttagcaaaaaatgtatctaatactggtcactgggggaatggagattatgaaatcaccattgaaagcacccaatatcttgaatacattatgagtttaattaaacaagctattaaggattaa

SEQ ID NO: 2357 - DNA, 4533 bp, H. influenzae strain 86-028NP
atgtctgatgtttttgaattagaaaatgaaatcgaattagagagcgatgaagtcattatggaaaatgaaaacgtcgaagaaatcgttgacgcacctatgccttttagcatgacgacaaataatggtgtagagcgtggtaaattccgttctttaaccttaattaactggaatggtttttttgcccgtactttcgatttagatgaattagttaccacgctttctggtggtaacggtgcaggtaaatcaaccacaatggctggatttgtgaccgcattaattcccgatttaacccttttacatttccgtaatacaacagaggctggctccacaggcggttctcgcgataaaggtttacatggtaaattgcgtccaggtgtttgttacgcggtattagataccattaactcacgtcatcaacgtattcttgtcggtgtgcgtctgcagcaaattgcgggtcgtgataaaaaggttgatttaaaaacgttttcaattcaaggtgtagaattatctcaaaatccgaccgcacttttcacagaaaccgtgggcgaacgtcaagctcgcgtccttaatttaaacgaactcaaagataaaattgaaaatatcggtgcacaatttaaacaatatcattccatcaccgattatcacggcatgatgttcgatttaggtattattccgaaacgtttacgttcagcatcagaccgaagcaaattctataaacttatcgaagcatctttatacggcggtatttccagtgcaatcacacgctctttacgtgactatttattgccagaaaatttaggtgtgcgcaaagctttccaagatatggaaagtgcattgcgtgagaaccgtatgactttagaggcgattaaggtcacgcaatcagatcgcaatttatttaaacatttaattactgaaaccactaattatgttgcttcggattatatgcgtaatgcgaatgaacgccgtggcaatattgaggctgcattagaatctcgtcgcgagtggtataaagcaaaagcagagcagaatttatctcaacatcgtttagttgatttaagtcgagaagcggctgaattggcagaaaatgaacgtactttagaagttgatcaccaaagtgcggttgatcatcttaacttagtgttaaacgctttgcgtcaccaagaaaaaatcacgcgctatcaagaagatattgcagaactcaccgagcgtttagaagaacaaaaaatagtggttgaagatgcgaatgatgcgttagaagaaagccaagcccaatttgagcaaactgaaattgaaattgacgctgtacgagcgcaattagcagattatcaacaagcattagatgcccaacaaactcgcgcacttcaatatcaacaagccattactgcactcgaaaaggctaaaaccttgtgtggcttagctgatttaagtgttaaaaatgtagaagattatcacgcagaatttgaagcccatgctgaaagtttaacggaaactgtgcttgaacttgagcacaaaatgtctatttctgaagcggcaaaatctcagttcgataaagcgtaccaattagtatgcaaaattgccggcgaaattccacgctcgagcgcgtgggaaagtgcgaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgcagagcaagaagcgttgattgaagatatttcagcaagactttcagaacaagtggaaaaccgttctacgcttcgtcaaaaacgtgaaaatttaaccgcactttatgatgaaaatgcgcgtaaagcaccagcatggctgacagctcaagctgcattagaacgtttagagcaacaaagtggcgagacgtttgaacatagccaagatgtgatgaactttatgcaatcacaacttgtgaaagaacgtgaactcacgatgcaacgtgatcaacttgaacaaaaacgtttgcaattagatgagcaaatttctcgtttaagtcagccagatggttcagaagatccgcgtttaaatatgctggcagaacgttttggtggtgtactgctttcagagctttacgatgacgtaaccattgaagatgcgccttatttctccgcactttacggacctgcacgtcatgctattgttgtgcgtgatctcaatgcagtgcgtgaacaacttgcgcaattagaagattgccctgatgatttatatttaattgaaggcgatcctaccgcatttgacgacagcgtattgtccgcacaagaacttgagctaggtgttgtcgtgcaagtttcagatcgtgaattacgctattcaagattccctgaaattccattatttgggcgagcagcacgtgaaaaacgtttagaagaattacaaattgaacgtgatgaagtggcagaacaatatgcccaaattgcgtttgatgtacaaaaatgccaacgtttacacgaacatttcagccaatttgttgggttgcatttggcgctggcattccagccaaatccagaagagttaatgtctgagattaatcgcgaacgtaatgaaattgatcgtgaattaaatcaattcaataacggcgaacaacaattacgcattcaattagataatgcaaaagaaaaactacagttactcaacaagttaattccacagctcaatgtattgactgatgaagatttaattgatcgtattgaagaatgtcgtgaacaattagatattgcagagcaagatgaatattttattcgtcaatatggcgtaacgttgtcacaattagagccgattgccaatagtttacaaagtgatccagaaaattacgacggcttaaaaaatgaattaactcaagcgattgagcgtcaaaaacaagttcaacaacgtgtatttgcgttagctgatgttgtacaacgtaaacatcattttggttatgaagatgcagggcaggctaaaacttctgaactcaacgaaaaacttcgccaacgtttagaacaaatgcaggctcagcgagatatgcaacgtgagcaagttcgtcaaaaacaaagtcaatttgctgaatataatcgcgtattgattcagttacaaagctcttacgatagtaaatatcagcttttaaatgaattgattagtgaaattagcgatcttggcgtgagagctgatgatggtgctgaagaacgcgcgcgtatccgtcgtgatgaattacatcaacaactttcaacgagccgtcagcgtcgttcttatgtagaaaaacaactcacattaattgaaagtgaagcggacaacttaaatcgtctaatccgcaaaactgaacgcgattataagactcaacgtgaattagtggtagcagcgaaagtgagttggtgtgtagttttacgtctatcacgtaattctgatatggaaaaacgcctcaatcgccgagagctcgcttatttatctgcagatgagttacgttcaatgtcggataaagcattaggtgcgttgcgtacagcggtggcagataatgaatatctacgtgatagcctaagagtgtcggaagatagtcgcaaacctgaaaataaagtgcggttctttattgcggtgtatcagcatttacgtgaacgtattcgtcaagacatcattaaaacggatgatccaattgatgccattgaacaaatggaaattgagctttctcgtttaacggctgaattaactggccgtgagaaaaaattggcgatcagttctgaaagtgttgcaaatattatgcgtaaaacgattcagcgtgaacaaaatcgtattcgtatgctcaatcaaggtttgcaaaacatctcgtttggtcaagtaaaatctgttcgtttggtagtgaatattcgtgatacccatgccatgttgttggacgcactttctggtcagcaagatgaatatcaagacttatttaacgacaactgcatcaccttttctgaagctatggcgaagctctatcaacgtatcaatccacatattgatatgggacaacgcacagcacaaacaatcggcgaagaattgttagattaccgtaattatcttgaacttgaagtggaagtattccgtggcgctgatggttggttacgcgctgaaagtggcgctctttctactggtgaagctatcggtacaggtatgtcaattctcttaatggttgttcaaagctgggaagaagaaagtcgtcgaattcgaggcaaagatattgtgccttgtcgcttgttgttcttagatgaagcagcgcgtttagacggtaaatctatttctaccttattcgaactttgcgaacgtttggatatgcagttgcttattgctgcgccagaaaacattagcccggaaaaaggaacaacctataaactcgtgcgtaaaatcgcaggcaaccaagagcatgtacacgttgttggtttacgaggattcggtgcgacagaataa

SEQ ID NO: 2358 - DNA, 735 bp, H. influenzae strain 86-028NP
atgacagacaaccttcaagatgtaatttccccaaaactcgctgtggcgattgcaaatccaatatttccagcggtagatagtctattgcgctcgggtcgccatatcagcacggagcatttagataatcacgcatttttaatggatttccaaaatgaattagacggattttatcgtcgctataacgtggaactaattcgtgcgccagaaggattcttctatcttcgcccgaaagcaacgacattaattgcacgttcagtactttctgagttggaaatgcttgttggtaaagtgctttgttatctttatttaagcccagaacgtttagcccaacaaggtatttttagcacgcaagaagtgtatgatgaattattaaatcttgctgatgaaggaaaattattaaaagcagttaatcagcgttcaagtggttctgacttagataaacaaaaattggcagaaaaagtgcgagctgcaattggtcgtttacgtcgtttaggtatgattcaaaccgttggcgaacaaaatagtgggaaatttactatttctgaatctgtatttcgttttggggcggaagtgcgtagcggagatgatccattagaggcccaagctagactcattcgtgatggggaagcggcaacacctgaatccttatcgttggaaaaacaagcacaattagtggaaaacgatacagaaagtgcggatgaaattgacgaagaatttgacggagaacaagaataa

SEQ ID NO: 2359 - DNA, 1059 bp, H. influenzae strain 86-028NP
atgaacgatattcaagtagcaaaagaatctttagataaaattataaagaaagcaagagtacatttatacaagcctatacaaattgctgaaattctttatcaagatagagttaataaaaatattaatttattagataaagaaacatatcgaaatatttctaaaaaatggcgggatgttatttgtatccgttttttaggaagagtatcaacatcgtcagctaaatatcaagacgatttatttaatgataacgctatgcctcccaaacatttaaatatattaggagaaatgaatagaaaaacaaatggtggagtagaaagttatatttataaaaagttttttgaacgctttaatcagatgtcatcagccttagagtatagttattctcgtactccagataattttcatctaagtgaatttcttgctcttttttggttagaacccggtttaaaacgaagtattgataaagtttatgaaatagttgtttatgcgttgttttcatctttaatagaggctttaggcgttaaagtaaaaattgatttagatttatcgaatattgatttgttaaaggagtttgaagattttactcgtcaaattatttctcttgatagtgagaatactagtttggaacttaatgcaaaaattaatagagttggtgtaacaaatgcttcagatcggggtttggatatgtgggctaattttggtatggcaattcaaataaaacatttatcattaactgaagaattagctgaaaacattgtatcttcagtttcatctgaccgaatagttattgtatgtaaagagagtgaagaaaaacttattttgtctttattaaatcaaattggttggcgttctaagattcagagtattatcactgaggcagatctaataaaatggtacgataaagcattgcgcgggaaatctgcatatttagtgggaagcaagatattagaacatatcagaaatgaaataagtttagaatttcctgcaaccgatatagtagatttcaatcacttttttcatgaatgtgaatacaataaagcattagatattgagaaataa

SEQ ID NO: 2360 - DNA, 957 bp, H. influenzae strain 86-028NP
atgaaagaatataaaacaatagatttgtttgctggaattggtggcattcgtctaggttttgaagcatttggatgtaaaaacgtattttcatcagaatgggataagtatgctcaaagtatgtatgaagtaaattttggcgaaaaaccttttggagatattaatgatatatctcctagcgatataccagatcatgatattttacttgctggatttccttgccaaccatttagtattgctggtaaaggattgggctttgctgatactagaggaacattattttttaatatagaagcaattttgaaagctaaaaaaccaaaagcttttttgctggaaaatgtaaaaagattaacaacacatgataatggtaatacatttaaagttattaacgataaattaaataagttaggatatacggtatatcataaagtattaaatacccttgattttggattaccacaaaaaagagagcgaatttacattgtgggttttttagataaattgcattttgaatttccaaagcctataggaaagtatgaagaactttctaatatattagagagtgatgatgttgttcctaataattattttctttcagatgaactaaaacggaaaagattaagttcaattactaaagatgtgccttatccttcaatttggcatgaaaatatttcaggaaatgtttctgctcttccatactcttgtgcattaagagctgggggaagttataattatctagttgtaaatggggtacgtcgattaactgggcgagaaatgctaagattacaaggatttccagatacttttgaaattaatataccttattctcaggtacgtaaagttgctggcaattcagttagtattcctgtaattagggctattgctggttcaatgattaatagtttaaatatggcaacgcctaaaataaatcaagcaattcaactttcattattggactaa

SEQ ID NO: 2361 - DNA, 1428 bp, H. influenzae strain 86-028NP
gtgcggtcaattcaaaagaagatttttaagatccgcaaaaaatcctgtataatctttccaattttttgttcaattttaacgctttgcaattcaatgattgaaacatcccaaactattcctgaactcgtctcttgggcaaaagatcgcgagttttctttgaatttacctaccgaacgcttggttttcctgctggcgattgcaatttataacaacgaacgtttagacggcgaaatgttagaagccgatcttgtggatattttccgccacacgatgaatgcttttgagcaatccaccgatgccattgcaacacgagcgaataatgcaattaatgaattagtgaaacaacgtttgttaaatcgttttagtagcgaatttactgagggcttggcgatttatcgtttaacaccattaggtgttggtgtgtctgattattacattcgtcagcgtgaattttccgcattgcgtctttcagtgcaactttccattgtggcagatgaaattcaacgtgcttctgattctgcggaagagggtgtggagaataatgaaagtgaacattattggcgtcgtaatgtgtttgcgccattaaaatattccgttgcagagatttttgatagcatcgatctttcacaacgtattatggatgaaaatcagcaaagtattaaagatgaaattgcagagcttcttactaaagattggcaagcggcaatttcaagctgtgaacgtttattagatgaaacatctgggaatttgcgtgaattgcaagatacgctaaatgccgcaggggataaacttcaagcgcaattattgcgtattcaagattgtgtgattgggcgagatgatttgtattttatcgatcagttgattacggatttgcaatccaaactagaccgtattattagctggggacaacaagccattgatttatggattggttatgaccgccatgtacataaatttatccgaactgccattgatatggataaaaatcgtgtgttctcacaacgtttacgtaattctattcatcattattttgagcatccttggttcttatggacagcgcaagctgagcgtttagtcgatctgcgtgatgaagaaatggtgttgcgtgaagatgatgctttaggtgaattaccagaagaattgcaatacgaatccctttctgatttacacgatcaaattgtagagcatatgcaaggcttactgattgcttatcgtgaaaataaccgtccgattgatttgagtttagtgttaaaagaacaactggaaaattatccactttctcgtcattttgatgtggctcgaatcattgttgatcaagcagtacgccttggtatggcgaatgatgatttatcgggtatttatccagattggcaagcaattaataaacgtggtgctgaagtgcaagcgcatgtgattgataagtattaa

SEQ ID NO: 2362 - DNA, 933 bp, H. influenzae strain 86-028NP
atgacccagttagcccaacaagaaaaaaaacaaacctataattttaataaattacaaaaacgtcttcgccgtaacgtaggcaacgccattacagattttggaatgatcgaagatggcgataaagtcatggtgtgtttatccggaggcaaagacagttatacgcttctcgatattttgttgaatttacagcaaaatgcaccgattaaatttgatattgtggcagtgaatctcgatcaaaaacaaccagggtttccagaacacgtattgcctgaatatttagaaagcattggcgtagattacaaaattgtacaagaaaatacttacggaattgtgaaagaaaaaattccagaaggaaaaaccacttgttcgctctgctctcgcctacgccgtggaattttatatcgtactgccacagaacttggtgcaaccaaaatcgctttaggacatcaccgagacgatatgttagcgaccctatttttaaatatgttttatggcggcaaaatgaaatccatgccacctaaattgatttctgacgatggtaaacaaattgtgattcgtccgcttgcttattgcaaagaaaaagacattgagaaatatgccatcgcgaaggaatttccgattattccttgtaacctatgtggctcacaaccaaatcttcaacgccaagttgtaaaagaaatgcttaatacttgggatcgccaatatccgggacgcttagaaaccatgttcagtgcaatgcaaaacattacattgtcacatatgtgtgatccgaaattatttgatttcaaaggaatcaaacatggacaactaattgatggcattgaaggcgatacagcatttgatgaagaaaaaatcacaccaatgcaatttgaagacgaagatcaaactgatttttcaaacaacgaaatgattaactttaaagaagtaaattaa

SEQ ID NO: 2363 - DNA, 330 bp, H. influenzae strain 86-028NP
atgttgaatatcaatggaattgaagttgaaactgataaagatggttatttgctccacagccaacaatggaacgaagatgtcgctcgtgctattgctcggttagaaagtatcgaattaacagatgcccattgggaagtgatttactttgtacgagacttttatcaagaatataacacctctccagccatccgtatgttggtaaaagccatggctgaaaagcttggtgcagataaaggtaatagccgctatttgcaacgcttatttcctgaaggccctgcaaaacaagctacaaaattagcaggtttgccgaaacctgcaaaatgcctataa

SEQ ID NO: 2364 - DNA, 210 bp, H. influenzae strain 86-028NP
atgaaaattagtgcaagaaaccaactaaaaggtaaagttgtttcaatcgaaaacggttcagtaaatgcaatcgttcacattgatatcggtggcggtaacgtgctttcttctactgtgtctttagctgcagttaaagaattaaacttagaagttggtaaagaagcatacgcaatcatcaaagcaacttctgtaatggttggcgtagaataa

SEQ ID NO: 2365 - DNA, 2413 bp, H. influenzae strain 86-028NP
atgttgttattctgcacaacatttgttagtccatttgttatggggaaaactattgaaacaaccaacaaccaacaaccaacaaccaacaaccaacaaccaacaaaaatatattgcccgaaattgttgtgtatggcgacaataataaatcactttcttccgttaaaacactctcttctgacgagataagtaaaacgcctacatcaaacggtaatatcactgattatcttcgttctaatccccatattcgttatgaaaatagcgaccaagatggttttcaacgtggagaaatcaagcctgaaaatatttcaattaacggtgccgatccaaatcaaactgcttattttgttgataatgtcaatataaataatgaacttactgctgatagcgatatttttgatggttctatgcaagttgtacccggaattagtcacactcaagcttatttctttgatgcgactatgctttctaaagtggaggtacaagatagtaatatttctgctagcttagggggatttatggggggtgccgttatagccaaaacaaaacaatatagcggcactgatagcataaaacttaaatatcgcacgacaaattcctcttgggcaaaaatggaagctggagactcagtacaaaaaatacttaaacaagtaagaccagatcttgtcggagtggcagagctacaacctaaatatgataaacaaacattcaatattttggctgaaaaaaggctaaatgataatttaggaatggtttttggctatagccgtagaacatcatctattgaacaaaatcgtttaattggctttgatcaaaatgccaataataaagcacagttagacaaacaaaatcatcaacgactttccgataatcttttattaaatttcaattggacaccgcaagaaaaagaacgtattgaactcggtttacgttattcaaattataaagaattgaaatatttccaggaaaatataaataacaacgtaagcgattatcatcaagcattggggacaacactagcttgggtgcattcattcaactctggcgtttggacaaataccttagcatacgatcgttttaaagataagcgtaaatcatcctcaaatagtgttgaaacaacatctgtgttagatgaatattatgaagcgctttataattttgaaaaaggcgggcatggtaatagccgtttaacccaagataatttacatttttctactgaatatgtaatggatcctttttatttagcttctacggagcattctgtttctattggtggaatttatcaggcaactaaatatcaattctatcgtccacaagatgttcattcaaaaataacattatctactttgcaaagtgatgggagtatgaatattttcagatcagataaaagtacaacaccaaaagtcgtgttaaaaccagctatcaaaatatcgctatttatgctgaagatttaattaaatggcgtaaatttgaatttcgacctggcattcgcattgaacgtaatgattatttaaaaaacaataatattgccccgcgttttgttgcacgttaccgaccttgggataatacaggatttacactaggtttaaatcgttattacggtcgttcttttgcttcgttaaaattagcgaatggtattttaaagcttaataataatccaacacgtcagcatcagaacttttcatccctaaaaagcccttatgcagatgaattaagtttaagttttgaccaaaatatgggtaatttagcactgaaactcggttatattcatcgtgataataaaaatcgtatcatattgaaacgagagactataagggaaaacataaaaactagttatatcaatggacgtccattcggtgttgatatttatactttccaacttaacaatatagaaccttggaaattaggtaaaacttattggactacgtcacttggttttgattggttaaatacaaaacgagctgatggcgaagaatttgatctaaataaacttgtttctttagatggtaaattaatgacttatcgtgaaatgttacgacaagttaatagtaacactgaagattggattgctcgtttaggtattgatatgacgataccaaattacgatattacttggtcaaataaagtgtatatgaaagcaccaattcgtcgttatgatttgattaacagcgataacgatgatgacattccacgctatcgtagctatcactatggcagacacacacaatgggatagcagcattcgttggcaaccaaccattagaggtaagcatagcgtttatttgcaagtagatattttaaatgtacttaataaaacacgtaaaaataaagtcgctactgctatttctaccagcgatgaatatggtgtctatacgcctgggcgtgaattttggctagaagttggctatcaattctaa

SEQ ID NO: 2366 - DNA, 2781 bp, H. influenzae strain 86-028NP
atgaaaaaaacaaccgcactttttttacttatcttttcactaattgcttgtcaatcattggaactatcgcccaataatgatttaccttttgatccaaatattcagcacggtaaactatcaaacggtttgcaatactttgtattaaaaaatactgaacccaaagaacgcgtttatattcgattagtaattaatgcaggctcaatgcacgaagatgatgatcaaaaaggcattgcccatttagttgaacatatggcatttaatggctcaaagaaatatccagaaaatcaaattattaatgcgttagaaaaacttggaatgaagtttgcacgagatattaatgcttttaccgattttgaaaatacagtctatactttaaatttagatagcaataatcagcaaaaattagaattggcttttgatgttatcaatgaatggatgaataatattacttttttgcctaaagatgtggatggcgaacgtggtgtagtacaagaagaatggcgaagacgtttaagcccaatgttacgtattggcaataagaaaagtgctattgaaatggcgggttctcgttatgtattacgtgatcctattggagatatggatattattaaaacaatttcagctaaacgcgtcgctgatttttaccacaaatggtatcgaccagataatatgtcagtaattattgtaggcgatattgatacaaaacaagtagtaaaactattaaaacaaaacctatcccaagaaaacccaattactaaaacaacattggaaaaaattgattttaatattcctcttatcaacaaatggcgattagattctatttctgaacaaggcacaacaattccaagtattgaattaagtttttttgaaaatacaattgaaaccaatacattagcgagctataaacaagaattaattcagcaaattaccactcgattacttaacttacgtttacagcaatgggaaaaggaaacagaaaatggcgtagattctgcaaatttttatcgtactcatttaggtaaagaaaccctacaaagcattttttctctccagcttatagatacacaatattcaaaaacgatagataaattatttgcctttattgccagtataaaacaacaaggttttactcaaaatgaattaaacggcgagattaaacgcttaactcaactcaatgaaaaacaattaaatattcgttctggtagtttaaaaattgccgatgatctcattacttctgtggcaaataagcaagtggtattgagcgtaaatgatcgttatgaactcaataaacgttttttatctcaaattacattagctgatttacaacgcacgttaaatcaaaccttagcattaaaagcaaaattattattaatcactcaacctttgccacaaaaagccttgccttttgatgtagtagaaatagaaactcgttggaacaatgcaatgaaaatgcaacaacaccaatgggatgaaaaaaaacaaatcgaaaaattaccgcacttaacatttaacacaggctcactttcccaagaaaaatactgggatcgcggcgatatttatgaatttcgtttaagtaatggaagtaaattgatttaccactatagtgacaaaactccaaatcaagtacattttcgtgctgttactcaaggtggtttacgttctatcccagataaggactatcacttattgcgtgctgccgttagtgtagttgatgaaacaggtgttggagaactttctctttctgcggttaatcaaattttttcgcgtgatccattggtaattgcaactgtgattgatgatgataaacaaggttttactggtgtatctaaacctaaagatttggaaaatttactgacattgttccgcttaaaattacgttcttcgcctatatccgatcttgccttagaaaaatatcgacgtgaaacccgtgattatttcaaacagattgatttagaaacacaatttatgcaagccgtttcaaaactgcgttttccaaatattgaaactgtctatactcaaaaacaagcacagcaattagcatttgataaaaaccaattaagtaacgcttatcaacgttatattttaaataaaacagattttacctattttattattggcgatattgagcttaatcaagtaaagaaattggcagaacgttatttagcttctgttgaatcaaaaactcagatacgtcactttgtccctactattattcatacaccaactcaatcatttattatgaatggtttgaaagaaccgagagctgatgtagaaatataccttaccgcagataatacttggcgagcggaacaaaaatacttattcaatattcttgctgatattgtgcaagaaaaattacgcttaattctacgtgaaaaagtttcaggtgtttattctgtaaatagttggtttatgcaagatgttcatacaccacaaattgagggaaaaattgaatttagttgcgatcctaagcgagtagaggaacttacgcatcttacaaatcaggtgctagatgatattgtaaaaaatggcattgatgaaaatttattacgtaaaaaactagcggaacaacatactcagattcgacgtgaatttgattctttagtttcagttgcttcgattattgaagaaagttactggcaacaagataatccagatgccatttatacctatcaacatttagatcagttagcgacaaaagccacaatagatgcgttggctcaaaaagccctaaaaaaatcaggcagatttgtcagcgtattaaaagcagctacttattag

SEQ ID NO: 2367 - DNA, 1932 bp, H. influenzae strain 86-028NP
atgccaattattactttacctgacggttcccaacgtcaattcgatcgtcctgtttctgttcttgaagtcgcacaagatattggtgcgggtcttgctaaagccactatcgcaggccgtgtaaacggagaacgtcgcgatgcgtgcgatgttatcgagcaagatgcaacgttagaaattattactgcaaaagatgaagacggtttagagattatccgccattcttgcgctcacttgctcggacacgctattaaacaattattcccagatgtaaaaatggcaattggtccaactattgaaaacggcttctattatgatgtagatttagatcgctctttaacccaagaagatattgatgcaatcgaaaaacgtatgttggaattggcaaaaacaaattatgacgtcgtgaaaaaacgtgttacttggcaagaagcgcgtgatacctttgaaaaacgcggcgagccatacaaaatggcaattttagatgaaaacattgaacgtactgcaacgcctgcgttatatcatcacttagaatatattgatatgtgccgtggaccacacgtgccaaatatgcgtttctgtcagcatttcaaattacaaaaagtcgctggtgcgtactggcgtggcgacagcaaaaacaaaatgttacaacgtatctatggtacggcttgggcggataaaaaacaacttgctgaatatttaacacgcttagaagaagcggcaaaacgcgatcaccgtaaaattggtaaagcattagatttatatcatatgcaagaagaagcaccaggtatggtgttctggcacaatgatggctggacaattttccgtgagcttgaaacgttcgtgcgtactaaattaaaacaatacgattatcaagaagtaaaaggcccatttatgatggatcgcgtattgtgggaaaaaacaggtcactggcaaaattacgcagatttaatgttcacaactcaatctgaaaaccgtgaatacgcaattaaaccgatgaactgccctggccacgttcaaatttttaatcaaggtttaaaatcttaccgtgatttaccaatccgtatggcggaatttggttcttgccatcgtaatgaaccatcaggttctttgcacggtttaatgcgtgttcgtggctttactcaagatgatgcgcacattttctgtactgaagatcaaattgagagcgaagtaactagctgtatcaaaatggtgtacgacatttatagcacctttggtttcactaatatcgcagtgaaactttctactcgtccggaaaatcgtatcggttcagatgagatgtgggatcgagcggaagcaggtcttgcagcagcattagcacacaacggtcttgaatatgaaatccaagaaggtgaaggcgcattctatggtccgaaaattgagtttgcactacgagattgtttaggtcgtgaatggcaatgtggtacagtgcaattagacttcgcattaccaggtcgtttagatgcaacttatgtggcagaagataatagccgtaaaacccctgtcatgattcaccgtgcgattttaggttctattgagcgtttcattggtatcattactgaagaatatgctggtttcttccctgcgtggttagccccaacccaagcagttgtgatgaatatcactgatagccaagctgactatgtacaacaagtcgttaaaaccttatctgatgcaggtttacgtgttaaagcagacctccgaaatgaaaaagtgggcttcaaaattcgtgaacatactttacgtcgcgtgccttatatgctcgtttgtggcgataaagaaatcgcagaaggaaaagtggctgtacgtacccgtaaaggtgctgatttaggtacatttactgtggaagaatttgcggaaatcttgaaaaatcaagtaagaagtcgtgaattaaagttattgaatgaagagtaa

SEQ ID NO: 2368 - DNA, 585 bp, H. influenzae strain 86-028NP
atgagcaacgtattagtattaaaatctagcatttcaggaaataactcgcaaactaatcaattagctgattatgttatcgaaaaattacaaggtaataacattgtagtacgcgatttatcccaacaacctcttccatattttgataccgcagctgcaattgctgtgcgtggagaaccaaaaacaacagaagaaaaacaacttctggcgttgtctgataaactaatcgaagaattaaaaaacgcacaaacattgataattggtgcgccgatgtataatttaaacgttccaacacaattaaaaagctattttgattttatcgcacgtccgcgcgttactttccaatatacagcaaacggctctgagggtttattaaaaggcaaaaaagccattgtgttatgtgcatttggtggattgtatgatgaagaaaatctagtgacacaatatatgaaatcaattttaggttttattggcatcacagatgtgcaatttgtttatgcacaaggcattggattcgggccagaggcgattgaaaaagcccaagcgtccgcaaaaaataaaattaatgaaattgtagcagccctttaa

SEQ ID NO: 2369 - DNA, 2607 bp, H. influenzae strain 86-028NP
atgagtaaatccttggtgattgtggagtcgccagcaaaagcaaaaactattaataagtatttaggtagccaatatgtcgtgaaatcgagcgttggacatattcgtgatttgccgacggttggttctagtacaggtgaaaaagctaaaccaatttcaaccaaaggtatggatgccgaagaaaaagcaaaaattaaggcagaaaaggaacgtaacgccttagttaaacgtatggggattgatccttatcacgattggaaagcaaattatcagattttgcctggtaaagaaaaagtggtttccgagttaaagtcgcttgctaaaaaagcagatcacatttatctcgcaaccgacttggatagagaaggggaagcgattgcatggcatttacgtgaagtgattggtggtaacaatgatcgttttagtcgcgtggtgtttaacgaaatcactaaaaatgccattaaacaggcttttgaaaagcctgaacaattaaatatggatcgagttaatgcccaacaaactcgtcgttttttagatagagtagtgggctttatggtgtcaccattactttggaaaaaagtggcacgcgggctttctgctggtcgagttcaatcggttgcggttaaattattagtcgaacgcgagcgtgaaattaaagcgttccagcctgaagaatattgggaagttgccgtccttacgaataatcaaaataaacaagctatacgcttggatgttacggattataaaggcaagaaatttgatccaaaaaatcaaaaagaagcacaaagtgcggtagattttctgaatgtttcagattacgttgtcacagatttggaaactaagccaacaagttctcgccctcgagcaccatttattacatcaacacttcaacaaacggcaagtactcgcttgggatttggcgttaagaagacaatgatgttagcccaacgtttatatgaagcgggttacattacttatatgcgtacggattcaaccaatttgagtcaagatgcgctgaatatggcgcgtagctatattgaaaatcattttggtgcacaatatttaccagaaaaaccaaatttttattctagtaaagaaaatgcacaagaggcacatgaggctattcgtccatcggatattcgagcattgcctgaatccttagagggaatggaaaaagatgcggtgcgcctttatgatttaatttggcgtcaatttttagcatgtcaaatgccacctgcacaatatgatagtagcacgctgaccgtttccgcaggcgattataccttgaaagcaaaaggcagaattttacgttttgatggttggacaaaagtattgccacagataggtaaaaatcctgaagatcaagaattgccttcagttactgtgtcagaaaaacttgctttaaaagaagtgcaaccaacacaacactttaccaaaccacctgctcgttttactgaagcggctttagtaaaagaattggaaaaacgtggtattggcagaccttccacttatgcggcaattatttccactattcaagaacgtggttatgttcgcactgaaaatcgtcgtttctatgcagaaaagatgggcgaaattgtgactgatcgcctcaatgagtcttttggcgaattaatgaattacgatttcaccgcgaatatggaagataccttagataaaattgcctctggttcagtaaattggaaaactgaattgaatcaattctttaaggatttttctagccagctttctaaagctgaattagatgaacttgaaggcggtatgcgtccgaataatctcgtggaaaccgatattaaatgcccaacctgtgacagaaatatggccattcgtacggcaagtacgggggtatttttaggatgctcgggttatgcattgccgccaaaagagcggtgcaaaacaacgattaatttaattcctgaagcggaattattaaatgttttagatgaatcttcagaaactaaagcattaatggatcgtaaacgttgcacaaaatgtggaacggcaatggacagctatgtaatcgatgcacatcgtaaaatccatatttgcggtaataatccaaattgtgatggatatttaattgaagaaggctcattcaaaattaaaggttatgatggccctgttgttgagtgtgataaatgcggtgcggatatgcatttaaaacttggtcgttttggcaagtatatgggatgtacaaattgtgataacacgcgcaaaattttgaaaagtggcgaggtcgcaccaccgaaagaagagccagtacatttccctgagttaaaatgcgaaaaatctgatgcatattttgtattgcgtgatggtgcgagtggggtatttatgtcagcacataacttcccaaaatcccgcgaaacacgcccagttaaaatcgctgaacttgtgcaatatcgcgagcgtttacctgaaaaattagcttatttagccgatgctccacaaaaagacccagaagagaatgaagcgattgttcgttttagtcgcaaagagaaaaaacaatatgtcacttctgaaaaagagggaaaagcgactaaatggattgttgatttcaccaatggaaaatgggttgaacgaaagaaataa

SEQ ID NO: 2370 - DNA, 918 bp, H. influenzae strain 86-028NP
atggataaactcaacgcgatttctattttctgcaaagtcattgaaactcaaagttttacattggcagcaaagcaacaaaatatttctgtggcgatggcaagcaaattagtttcacaattagaagaacatttaaaaacacgattgttacaacgtaccaccagaaaaattatgcctactgaagctggaataatgtattatcaacgctgccaaggaattttacttgatttagatgaagcagattccagcatcacccaccttaccagttcattacaaggaaatttactgatttccgttcctcgtgattttggtttactttttattgcaccaaatttacccacttttatggctaagcatcctcatttgcatattgaagttgaatttaatgataagaaaatcgatttattatccgaaggctatgatcttgctcttcgtattggttatatggaagatagctcgttagtttcacgtaaaataggaactactactgttcattttgcagcgtcgcctaattatcttgaaacgaatggtattccacaaacgcctgatgatttagaacatcacaatggcttactttataaaaatgcaatgaatcaggtaaattgggttggttcacgtataaatcaaacccaacgtttcaaaatccaatccaaagtggtaagcaatagcggttttgccttattaaatatggcaaaagcgggactaggtattgctaatttaccaaaatttattttaggtagagcctttgaaaaaggcgagcttattgaaatattaccagaatataaacaacaaaaattagaaattcatgtggtctatccaaacagaagacatttaccaataaaagtacgggcatttattgaatttttatctggcttaggcttgtgttcagaaattttggaaaatcatgaagataatatttaa

SEQ ID NO: 2371 - DNA, 1425 bp, H. influenzae strain 86-028NP
atgtctgaaggtttagtacaggctgcgtatattttagcagcattacttttcattatgagcttggcaggactttctaaacatgaaactgctaaagcaggttgttggttcggtattgttggtatgacaattgcccttatcgcaaccatttttggccctcattctgaaggaacattttggatcattattgcgatgatcattggtggagcaatcggtgttcaacgtgcattaaaagtagaaatgactgaaatgccagaactggtggcgattcttcacagttttgtcggtttagcagctgtactcgttggctttaatagctatggtttacaccatgaggcgttaatgccagaaggattagatgcagcagcacaagccgcatttgtagcagagcaagtagtattaacgaatattcataatgttgaagtatttttaggtatttttatcggtgcagtaactttcactggttctgttgttgcatttggtaaattaagcggaaaaattaattcaaaagcattaatgttaccgcatcgccataaattaaatttagccgcacttgtggtatctgcattattgatggttgcattcttgaataatccagaaagcattttccctgtgttattaatgacagcgattgcgcttgcatttggatggcacttagtggcatcaatcggtggggcagatatgccagttgtggtatcaatgcttaactcttattcaggttgggcagcagctgcggcaggttttatgttgaataatgatttgctgatcgttacaggtgcgcttgttggttcttctggtgcaattctttcttacattatgtgtaaagcgatgaaccgttcatttgtgagcgtcattgcgggtggttttggtaacgatgttcaagtttcttcaagcgaagaacaaggcgaacaccgtgaaactacagcagaagaagtagctgagttgttgaaaaatgcaagttctgtgattatcacgccgggatatggtatggctgttgcacaagcacaatatccagtcgctgatattacggcaaaattgcgtgaacgtggtgtgaacgttcgttttggtattcaccctgttgcaggacgtttaccgggccacatgaacgtgcttttagctgaagcgaaagtaccttacgatgtcgtacttgaaatggatgaaatcaatgatgattttgctgataccgatgtggtattggttataggtgcgaacgatacggtaaacccagcggcgatggaagatccaaatagcccaatcgcgggaatgcctgtgttagaagtatggaaagcacaaaatgtgattgtgttcaaacgttcaatggcagtgggttacgctggcgtacaaaatccattattcttcaaagagaatacgcaaatgctctttggtgatgcaaaagatcgcgttgaagatatcttaaaagcattataa

SEQ ID NO: 2372 - DNA, 1539 bp, H. influenzae strain 86-028NP
atgttaattggtgtacctagagagctgcttgagaatgagagccgtgtggcggcaacgccgaaaacggttcagcaaatattgaaattgggctttgacgtgatcgtggaacacgatgcaggttttaaagctagttttgaagatcaagcatttttagaggcaggcgcgaagatcggtacgtcggctgaaatttggcaatcggatattatcttcaaagtaaatgcaccgacagatgaagaaatcgctcaaatgaaggaaggagcaactctcgtgagctttatttggcgcatgcaaaatcctgagttaatgaaaaaactcaccgcgaaaaaaattaatgtgttagcaatggatgcggtgcctcgtatttctcgtgcgcaagcattggatgcgctttcttctatggcgaatatttctggttatcgtgctgtcattgaagctgcgcatgaattcggtagcttctttactgggcaaattactgcagcaggtaaagttccaccagcaaaagtgttggttattggtgcgggtgtggctggtttggcggcaattggtgcagcaaatagccttggggcgattgttcgtgcttttgactctcgtcctgaagtgaaagagcaagttcaaagtatgggtgcgagcttcttagaaattgatttcaaagaagaaggtggcagtggcgatggttatgcgaaagtgatgtcggaagaatttaaccgtcgtgcgatggagctttatgcagaacaagctaaagaagtcgatattattattactacggcagccattccaggtaaaccagcgcctcgtttaatcaccaaagaaatggtagattcaatgaaaccaggttcggtgattgtggatttagccgctgcaactggcggtaactgtgaatatacgcaagcagggaaagttgttacaactgaaaaccaagtgaaagtgattggttatacagatttcccaagccgtttaccaacgcaatcttctcaactttatggcacaaacttagtcaatttattaaaacttttgtgcaaagagaaagatggcaatatcaatattgattttgaagatgtggttcttcgtggtgtaaccgttgttcgtgatggggaagaaattccaccagcacaaattcaagtgtctgcacaaccaaaacaagaaaccaaagctgcaccagtggcagagaaaaaagaatctaaaccaacagatcctcgtgtgaaatacggtgtgatggctggtgttggcgtgttattcctttggttagcttctgtggcgccagctgcatttttatcacatttcaccgtatttgttttagcttgtgtggtgggttattacgtggtttggaatgttagccatgcacttcacacaccattaatggcagtaacaaatgcaatttcaggcattattattgtaggtgcgttattacaaattcgtcagccaacaggcaatctatttatcgatgcgttagcttttgtggcgattttggtggcaagcatcaatatttttggtggtttccgtgtcacacaacgtatgttagcaatgtttagaaaaggttaa

SEQ ID NO: 2373 - DNA, 2466 bp, H. influenzae strain 86-028NP
atgataatggataactttgattctccattccaatataatcgtcctgaaatgaccgttgaagcgattaaaaaatcaatcgtttacaaacttattttcttaatcggtcgctctccacgtgaagccagccaacgcgattggctcaatgcaacacttcacgctgtgcgtgatttagtaacagagggttggatcactactgctcgccaaactcgagcagaagattctcgccgtgtttactacctttcaatggaatttttaatcgggcgtacgctatctaatgcaatgattgcagaaggcatttatggattagcacaggaagcactttctgaattaaatgtggatttagaagaagttttagaaaaagaagtagatcctggcttgggcaatggtggtttaggtcgtttagccgcttgttttatggattctattgcgacccttggtttaccgggtatgggctacggtattcgttatgaatatggtatgttccgccaaaaaattgaaaatggtcagcaagtcgagcgtcctgatgcatggcttgaaaaaggagcaccttgggaatttattcgtccatctaaacgctttaccgtagaatttggtggaaacattcatttcgaaggcaaaaaatgtatttggcaagataccgaaaaagtaaccgcacttgcttacgatcaaatgatcccaggttatcaaaataattctgcagcaacattacgtttatggtcggcacacgcaggcgaagtgtttaaccttgccgacttcaaccgtggcgaacatttagccgcattagaagagcactccgcaaataaaaatttatcacgtgtactttaccctgatgattctacttggaatggtcgcgaattgcgtttacgtcaagagtatttcttagtctctgcatcgcttcaagatattttacgccgtcacaaacgcacccacgacagccttgaaaacttggcggataaagtggcgatccacttaaatgatacccacccagcgttagcgattcctgaattaatgcgtattttagtggacgatgaaggtttcgagtggaaaaaagcgtgggagatgacgcgtaacattttctcttacacctgccatactttaatgtccgaagcgttagaaacttggcctgtggaaatgatggcaaaaatcttgccacgtcatttacagatgatttttgaaattaacgatcacttcttagaatatgtccgcacttatgtaacgactgacaacgattttatccgccgtgtttctcttatcgaagaaggctaccaacgcaaagtgcgtatgggatggctatccgtagtaggttcacacaaaatcaacggggttgccgaaattcattccgatttaatggtaacttcaacctttgcagattttgctcgtattttcccagaacgctttaccaacgtaacaaacggtatcacaccgcgtcgttggttagccgtggcgaacccacaattagccgcattgtttgataaatatatcggttcagaatggcgttgtgatttaagtcaaatcgaaaaacttaaaccatttacgcaagaaaaagcatttaaagaggctgttgctgacattaaatttgctaataaagtgaaattagcggaatacgtaaaacgcgagttaggggtagagcttgatccgcacgccttatttgacgtgcaagtaaaacgtattcacgaatataaacgccaaatgttgaacgtattgcatattattgctcgctacaatgaaatgcttgccaaccctgaaaaagattggcaacctcgcgtatttattttagcaggtaaagcggcttcggcttactatgctgcgaaacaaacgatccatttaattaatgatgttgctaatgtcatcaataatgatgagcgtttgaaaggccgtttaaaagttgtatttattccaaattacagcgtgagccttgcacagcttatcatcccagcagcagatatttcagagcaaatatcccttgcaggcacagaggcttctggcaccagtaatatgaagtttgccttaaatggcgcattgacactcggtacacttgacggtgcgaacgtagagatcttggaaaatgtgggcgaaaatcacattttcatcttcggtaatacggtagaacaagtggaacaacttcgtcgcgacggctatcgttcatttgaatactatcaaaacgatgctcaattacgcacagtcgtggatcaaattattgagggtaaattctcaccagaagaacctcaacgttatcatcaactattacaaggcttgcaataccacgattattatcaagcttttgctgatttccgcagttatgtagaaattcaaaaagccgtagatgaaaaatacaaacaacgcgaccaatggattgaaagtactattcaaaatatcgtgaatatgggcttcttctcatctgaccgcacaattaaagagtatgcggagagaatttggaaagttgagcctgttcaattaggtgattaa

SEQ ID NO: 2374 - DNA, 1431 bp, H. influenzae strain 86-028NP
atgaaaatactacacgtttgttcggaactctatccgctcttaaaaacaggcgggcttgccgatgttttaggggcattaccccaagcacagaaccaaattgggctagatgctcgcgttttattgcctgcttatcccgcaattatagcaggcattcagaatactcaagtggttgccgaatttgacaacttcgctgggcacgtggtgttgcgttatggagaatataatggtgtcgggatctatttgattgacgcaccgcacttatacggtcgcgaaggcaatccttatcacgatgcctattacaacgactacggcgacaactacaaacgttttgctttgctcggttgggtgggggcagaattagccacaggtttagatagctggtggcgtgcagaagtggtacacgctcatgattggcacgcaggtttgtgtgcagcatatctgttcaacaaaggtcgccctgcgaaatcggtgttcaccattcacaacttggcatatcaagggcagttttcttatcatcatttgtatgaaatcggcttgccgacagggatgttccacgtagaaggcttggaattatttgggcagatttcttacttgaaatcaggtttgttctattctgatgcaagcacggcagttagcccaacttatgcagaagaaatcacgacaccagaatttgcctacggtttgcaaggcttgctttctggcttaaaagctcaaggtcgtttggtggggattttaaatggtgtggacgaaaatatttggcatccgaacgtggatcaatacattccgcaccattacaagctcaaatatatggcaggcaaaaagaaaaacaaagccgaactgcaagcctatttcaatttgccacaagatgaatctgccttggcatttgtgatggttacccgtttaaccgagcaaaaaggtgttgatttattaatcgaaagtgcagacgaaatcgtcaaacaaggcggtcagttgatgattttaggttcaggtgcaccgcactttgaacaaggtattcgtgagcttgctgaacgttatccgcaaaatattgcggtaaaaatcggctacgatgaagccctttcgcatttaatggtggcaggtggcgatgtgattttagtgccaagtcgtttcgagccttgtggcttaacccaactttatggtttgcaatatggcacactgccacttgttcgtaaaacaggtggtttagcggatacggtggtggatagcacttcagaaagcatcaaagctcgcaccgcaacaggttttgtgtttgaaagtgcaacgcctgaagctctccgccattgcttgcaacgtgcctttgccttatggcaaaaaccgcgtgcatgggcgatggttcgtacagatgcaatggaacaagacttcagctggcgtaaggctgcagagcaatatagaacactttatgaacgcttgtag

SEQ ID NO: 2375 - DNA, 1335 bp, H. influenzae strain 86-028NP
atgacgaataacaataagactatggagatccttatgaaatctggcgaccttaacaaatatgatttagttaaaaacactttggtgcttgtacttgcaggtggacgtggttcacgtttacacgaattgacagataaacgtgcaaaaccagcgctttattttggtggtaatcgtcgcattattgatttcgcactttctaattgtattaactcaggtttaaaccgaattggggtcgtgactcaatatgcggcacactccttgcttcgtcatttgcaaacaggatggtcttttttaccacaagagagaggggaatttgtcgatatgttgccagctcgtcagcaaattgacgattctacttggtatcgtggcacggcggatgcggtatatcaaaatatggctattattaaaaatcactatcgcccgaaatatattttgatcttagcgggcgaccatatttacaaacaagattacagcgtgatgttaatggatcacgtcaatagtggggcaaaatgtactattggttgcattgaagtgccccgttctgaagcacacgaatttggcgtaatggctgtaaacgaaaacttgaaagtaaaagctttcgtggaaaaaccaaaagatccgccagcaatggtgggtaaacctgatgtttcgcttacttcaatggggatttatgtgtttgatgcggattatctttacaaaatgttagatcgtgaagttggcaccccgaacaccagccacgatttcggtaaagatgtattgccaaaatgtttagaagaaggcgcgctttatgctcacccatttagccgttcttgcatgggacgcaacaccgagggcgaaatttactggcgtgatgtagggacacttgatagcttctggcaatctaatatcgacttagtctctgaaaatccacaattagatatttacgaccaaagctggccaattcgtggtaatccggttcaggcttatccgtctaaattcttctataaacactctaacgtgcacccagtagataactcattgattggcgggggctgtgtgattaccgatgcatcgatcagcaattccgtgctttttgatcgcattaaaattgattccttttcaaaagtcgatcactgcgtggtgttaccacaagttaaaatcggtaaaaattgcgtgttgaaaaattgtattatcgaccgcgaatgcgaaattcctgatggtatgcaaattggtgtggatatggaagaagataaaaatcgcttccgtattagctcaacaggcaaagtcattcttgtaaccccgaaaatgctaaagatacttgagggacacgagattggcgaagaaggtcatttagattag

SEQ ID NO: 2376 - DNA, 1977 bp, H. influenzae strain 86-028NP
atgttcaaaatctacaacaacggcaatcctattccaatgggatactcacaagcggtcgaaaacaacgtgcaaattaccaatttcgccctgttttccgctgcggcaataggcgtagaactttgcctttttgacgaacaaaatcaagaaacacgcttgccgatggtgcgtactgaaaatgtgtggcatttggcggtaactggcgtgaaaactggtacggaatatggatttcgtattcacggcgaatttgccaacccgaataaattaatgctcgatccctatgcgaaagccgtaaatggtaaacctgatttaagtagcgaagaaagttgttcttggttcttgctttcggataatcgcgacaacgcgcatcttgccccaagagcggttgtgatttcggaagattttaattgggaaaatgatactttacccaatacgccttgggctgaaaccattgtgtatgaattacacgttaaagggtttagccagttaaacgagaaaatccctgcggcgttgcgtggtacttatactggattagcacatcctgtgaatttggcgtatttgaaagaattaggcgtaactgtggtggagttgctgcctgtaaatttccatataaatgaaccgcacttacaggcacgaggcttacaaaattattggggatacaatcccttagcgatgtttgcggtggaacctaaatatgcggcaacaaataatccattagctgaatttaaagcgatggtaaaggcgtttcacaatgagggtattgaagttatcttagatgtggtgtttaaccattctgcagaatcagagcaaacttacccaacattctgccagcgtggtattgatgatcaaacttactattggcgcaacgatcaagggcgttatatcaattggacaggctgcggcaatatgctcaatttatcctctgatgtagggcgaaagtgggtggtggattgcctgcgttattgggtggagcaatgccacattgatggtttccgttttgatttagcctccgtgcttggtcgtgatacaccagattttaattcgtcagctcagctttttactgacataaaaaatgagccaagtttacaaaatattaaattgattgccgagccttgggatattggacattacggttatcaagtcggcaatttcccaagttattttgccgaatggaacgaccgattccgtgatgatctctgccgtttctggctatggaaaagtggcgaaatcggtgcatttgcagaacgttttgcaggctctatcgatttatttaagaaaaatgaccgcttgccacatactacacttaattttattaccgctcacgatggttttacgcttaaagatttagtgagttacaaccaaaaacataatgaagcgaacggcgaagaaaatcacgacggcagaaacgaaaattacagttacaaccacggagtagaaggttctacagaatccctttctgaaccgcaaaaaagtgcggtggaaaataaccgcacttttgcacaaagtggattattaatgagtttattgctggcgaatggcgcacctatgcttttggcgggcgatgagttcggcaacactcaatatggtaacaataatgcttattgccaagataacgagattacttggctgaaatgggcaaattttaacgaagaattatttgaactgaccaagcaaacgatcgcactccgcaaaagaatgggcagtttaaaccaagatcaatggtggtcggatgagaatgtgcaatggcttaacattgcaggcgaaccgatgacagttgaagattggcaaaatcaacaaaccaaagcattacaggtggttttagacaatcgttggcttttgttgattaatgccaaagccgaaggtcaggtgtttcacttgcctaatgggaaatggaagccccaaatcggcacacataatgtaacccttgaagaacaagccgaacttagttcaatgggcttttgtatgctgaatgacgaataa

SEQ ID NO: 2377 - DNA, 2193 bp, H. influenzae strain 86-028NP
atgacaaccgcagtaacacaagcaactattgatggtttttttgatgcgagcaatggtgatccttttgctacgcttggtatgcacgaaaccgagcaaggaattgaaatccgtacgttattgccagatgccaatcgaatggtggtgattgagcgtgaaagtggtaaagaaataacggaactggattgtgtcgatgagcgtggattttttgttggtgttattccaaattgtcgtcaattttttgcttatcaattacaggttttttggggtaatgaagcacaaattatcgaagatccttatcgttttcatccaatgattgacgatttagaacaatggctactttctgaaggatctatgcttcgcccatatgaagtgcttggtgcacattttatggaatgtgatggtgtgagcggggtgaatttccgcttgtgggcacctaatgcaagacgagtttctattgtaggcgatttcaactattgggatggtcgccgccacccgatgcgtttccacccgaaaagcggtgtgtgggaattattcctgccgaaagccagccttggtcagctctataaatttgaattgattgattgctatggcaatcttcgtttgaaagcggatccttatgcctttagttcgcaacttcgccctgatacagcttcacaaattagtgcattaccaaatgtggtggaaatgacggaacaacgtcgtcaagcaaatcaagcaaatcaaccgatttctatttatgaagtgcatttaggatcttggcgtcgtaatttagaaaacaatttttggctagattacgatcaaattgctgatgaattaattccttatgtaaaagagatgggctttacccatatagaatttttaccgctttctgaatttccgtttgatggttcttggggctatcaaccacttgggctttattcgccaaccagtcgttttggctcacctgaggcatttcgccgtttagtaaaacgtgctcacgaagcaggcatcaacgtgattttagattgggtgccagggcatttcccaagtgatacccatggtttagtcgcatttgatggcacagccttgtatgaacatgaagaccctcgcgaaggctatcatcaagattggaataccttgatttataactatggacgcaacgaagtgaaaaatttcctgtccagcaatgccctttactggcttgaacgctttggcgtagatggtattcgcatggatgctgtggcttcaatgatctaccgcgattacagccgtgcggagggcgagtggattccaaaccaatacggcggacgtgaaaatttagaagccattgagtttttaaaacacaccaactggaaaattcacagcgaaatggcgggagcaatttctattgcggaggaatctacctcttttgcaggcgtaacccacccaagcgaagacggcggcttgggcttcaatttcaaatggaatatgggctggatgaacgatacactggcttatatgaagcttgaccccatttaccgccaatatcatcacaacaaaatgacctttggaatggtatatcaatacagcgaaaattttgttctaccactttctcacgatgaagtggttcacggtaaatattcacttcttggcaagatgccaggcgatacgtggcaaaaattcgctaacttgcgtgcatattacggttatatgtggggctacccaggcaaaaaattgctctttatggggaatgaatttgcccaaggtcgtgagtggaattatgaagaaagtttggactggttcttgcttgatgaaaatattggcggaggttggcacaaaggcgtattgaagctggttaaagacctcaatcaaatttatcaaaaaaatcgaccgctctttgagctcgacaactccccagagggtttcgattggcttgtcgttgatgatgcggcaaattctgtgttcgcctttgaacgtcgcagttcaaacggagaacgtattattgtcgtcagtaactttacccctgtgcctcgccacaattaccgcatcggcgtgaatgttgcaggaaaatacgaagaaattttaaataccgattcgatgtattacgaaggttcaaacgtgggcaattttggttgtgtcgcaagtgaaaaaatcgaaagccacggacgagaaaattcgatttcagtgtccattccgccgttagcaacagtttatttgagattgaaggcgaaataa

SEQ ID NO: 2378 - DNA, 2100 bp, H. influenzae strain 86-028NP
gtggtgtctatgcaaatctcggattctctcaaacaaaaagcagaaaaatgcggtatcgcgctttctcactatgatattgatgggcatcttatttttgcggatgaaaagacggttttaacttttgttgagcttttgcagcctccgccaaaagcgaaaggacagtttgacgatgtactggctgcatttgaaaatgaaccgattgattatcgactcaatcgtctagatctcccaccatctgcggaatatcgttatcagctgattgatgaatctaatgctattctgttagaaaaaatactttcaaatttatccgcactttctttgcctccacttccttttggctattatcaattatctattttttctgacactgaacagtatcgcgttcgtttacttatttctcctaaaacagcttttcaaccatccgtattaaaaaataaaaaagtgtggggcgtgaatgtgcaactttacagtttacgctcagaacaaaactgggggattggcgattttggcgatttggctgctttgattgaacaaagtgcaaaacaaggggcggattatgtgggaattaatccattacatttgccatatcctgctgtgccaaattgggctagtccttatagttcatcctctcgtcgttggttgaatttcttatatttggacattcctgatttacccgaatttaagcgttgccgttcagtacaaaattggtttaagcgtgaggatattaaagcaaaaattgctgctttacgtgaaagtgattgcgtcgattattcttcaattttggctttaaaattaaccgcacttgagtccctgttttatttctttcagcgtagtcaatccgttgaaattgtgacacgtcgaaaaatctttgctgattatttaaaaagcaaaggggaacctttgttgttacagggcttatttaatgtcttggatttacaagaacacgctgaccatcaagcagaagaaaataccattggttggcttggctggcgtaaggaatggcagcatttaagtgcggcaaaaagaaaagccctattaaaaatacaccatgagcaaatccaattttttgcttggttgcaatggcttacagaagaacaactttccgcattacaaaatctttgtaaacagtctggcatgaagttgggtatttatggcgatttagccgtaaatagttctcgtggcagtgctgatgtatggagcgatcctgatttatattgtgtaaatgcctctattggtgcgccacctgatccgttaggcccagtcgggcaaaattggaatttgccaccttataatccaacagtgctaaaagcacgtggctttacaccatttatcgatatgctacgtgccaatatgcaatatttcggtgtgctacgcatcgatcatgttatgggcttattccgtttgtggtggattccaaaaggaaaaaccgcggctgacggtgcttatgtgcattatccttttgatgaattaatggcgattcttgccattgaaagtgtacgcaatgaatgtttgattattggtgaagatctcggcactgtgcctgatgaagtgcggtggaaattaaacgagtttcaaattttctcttattttgtattgtattttgcccaacgaaatggcgaatttcctcgtatatctgattatcctcgaaatgcttatgccactattggtacacatgatgttccctcattacaaagtttttggcattgccgtgatttagaattatttaatcaactcggtattctgaatggggaagtgctcaagcaaaaatatgatcaacgtgttatggataaacaagccttattaaatagtttacatcgtgataattatttaccgccgcattatgaaggtgatgcactttctatggcgatgcacgattatttaaatcgaatgatccattattatttagcggaaagtaacagccgattgattggtgtgcaattagaaaatttacttagccaagaaatcagttctaatttaccgggcacctcaaatgaatacccaaactggtgcaagaaacttgctcaaccgttagcgtttatttttagcaatgaagctttaaaaacgttctttgtgcaaattaaccaagggcgaaatgtataa

SEQ ID NO: 2379 - DNA, 465 bp, H. influenzae strain 86-028NP
atgcaatccaatatgcaacttgaacccaatttctggcaaacaaaatccctgcttgaaatgactgaatctgaatgggaagccttatgtgatggctgcggcaaatgctgttatcgcaaatatattcaagggcgaagtaaacgccaaaaactctattacacccgaattgcttgtaatcttttagatgtggaaacaggaaagtgcggtaattattcagagcgttttaacattgaaaccgattgcaccaaactcaccaaaaagaatttacctgattttcattggctgcctgatacttgcgcctatcgtttgctttatgaaggaaaaacactacctgaatggcatccgcttatttctggctctccccattctgtaaaaaatgcggatattttgattaaaaatggtatccacgaacgcgatgtgattgattggtttgaatttattattgacgaagatcacacttttaaataa

SEQ ID NO: 2380 - DNA, 1674 bp, H. influenzae strain 86-028NP
atgatgagccatacagagacatctttgggtgcagaaaatacccgcactcataattttattacccaaattattgatgaagatttagcttcgggtaaacataaaagcgttcatacccgttttccgccagagccgaatggttatttgcatattggtcacgcaaagtctatttgcttgaattttggcttggcaaaagaataccaaggtttatgtaacctacgttttgacgataccaatccagtaaaagaagacgtggaatatgtagattctatcaaagcggatgtggaatggttaggttttaaatgggagggcgaaccgcgttatgcatctgattacttcgatgcgctttatggctatgccgctgaattaattaaaaaaggtttggcttatgttgatgagctttctccagatgaaatgcgtgaatatcgtggtaccttaaccgaacctggtaaaaacagcccatatcgtgaccgcactattgaagaaaacttagcgttatttgaaaaaatgaaaaatggcgaatttgccgagggtaaagcaagtttacgtgcaaaaattgatatggcttcgccatttatggtcatgcgtgatccagtaatttatcgtattaaatttgccagccatcaccaaacaggtgacaaatggtgtatttacccaatgtacgatttcacgcactgtatctctgatgcgattgagcgtattacacactcaatctgtacattagaattccaagataaccgtcgtttatatgactgggtgttggaaaatatcagtattgaacgtccattaccgcatcaatatgaattctcacgtttgaatttagaaggcactttaacctctaaacgtaaattattgaaattggtaaatgatgaaatcgtggatggttggaacgatccacgtatgccaaccatttcaggtttacgccgtcgtggttatacaccagcttcgttacgtgaattttgtcgtcgtatcggtgtgactaaacaagataacgtcgtagagtattcagcacttgaagcctgcattcgtgaggatttaaatgaaaatgcaccacgcgcaatggcagtgattgatcctgttcgtgtggtaattgaaaattttgaaagcgaagcggttttaactgccccaaatcatccaaatcgtcctgaattaggggaacgtcaattgccgttcacgaaagaactttatattgatcgagctgacttccgtgaagaagcgaacaaacaatataaacgcttagtattaggcaaagaagtgcgtttgcgtaatgcttatgtgattaaagctgaacgtgtagaaaaagatgcaaatggtgaaatcaccacgatcttctgtacttacgatcctgaaactttaggtaaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttctaa

SEQ ID NO: 2381 - DNA, 1476 bp, H. influenzae strain 86-028NP
atggatgctgtcgagttattgatgaacgtaacgcctaacgaaacacgcattgcgctagtagaaacaggaatgttgcgcgaagtgcatattgaacgccaagctaaacgaggaattgtcggaaacatttataaaggtcgtgtcactcgagtgttaccaggaatgcagtcggcttttgttgatattggtttggaaaaagcggcttttttacacgctgcggacattgtatcccatacagaatgtgtagatgaaaatgaacaaaagcaatttaaagttaagagcatttcagaattagtacgagaagggcaggatattgttgtacaagtggtgaaagagccgctaggtacaaaaggtgcacgtttaacaacggatatcacattgccatcgcgtcatcttgtttttatgcctgaaaatagccacgtaggcgtttcacaacgcattgaaagcgaagaagaacgcgcccgtttaaaagcattagttgaacctttttgtgatgaactcggcggttttattattcgtaccgccacagaaggggcaagcgaagaagaattacgtcaagacgctgaatttttaaaacgcttatggcgtaaagttttagaacgtaaatctaagtacccaaccaaatcaaaaatttacggcgagccagcacttccacaacgtattttgcgcgattttatcggcacaaacttagaaaaaattcgtatcgactctaaactttgctttggcgaagtaaaagagtttaccgatgaatttatgcctgaattaagcgataaacttgttctttattctggcaatcaacctatctttgatgtgtacggggttgaaaatgcgatccaaacagccttagataaacgtgttaatctcaaatcgggcggctatttaattatcgagcaaacagaagccatgaccaccattgatattaatacaggcgcatttgtggggcatcgtaatctagaagaaaccatcttcaataccaatattgaagcaactaaagccattgcgcagcaactccaactacgtaatcttggtggcataatcattattgattttattgatatgcaaacagatgaacatcgcaatcgagtattgcaatctttatgtgatgcgctttctaaagatcgtatgaaaactaatgtgaatggctttacgcaattaggccttgtagaaatgactcgtaaaagaacccgcgaaagccttgaacacgtgctatgcgatgaatgtccaacttgtcatggacgtggtcgggtgaaaactgttgagacagtttgctacgaaattatgcgtgaaattattcgggtgtatcatttattcagtagtgaacaatttgttgtttatgcctcgccagcagtttcagaatatcttattaatgaagaatctcacggtttactgccagaagtggaaatgtttattggaaaacgagtaaaagtaaaaacagaacagttttataaccaagaacagtttgatgtggttgtaatgtaa

SEQ ID NO: 2382 - DNA, 1515 bp, H. influenzae strain 86-028NP
atgtttggattcgacccaagtcttattacttttactatttatattttcgggatgttgctgattggcgtactcgcctattattacacgaataatttatcagattacattctcggtggacgtcgtttaggcagttttgttactgcaatgtctgcaggtgcgtcagatatgtctggttggcttttaatgggcttacctggtgcggtatatttatcaggcttagttgaaggctggattgctattggtttaactatcggggcttattttaactggcttttagtggctggtcgtttgcgtgtttatacagaattaaataataatgcgctcactctcccagaatattttcacaatcgttttggttcatcacacaaattattaaaacttgtttctgccactattattttagtgttttttactatttattgtgcttctggtgtcgtggctggcgcaaaattattccaaaatatattttctgtggaatattccaccgcactttggtacggcgcagcggcaaccattgcttacacgttcatcggaggtttccttgcggtaagctggacagataccattcaagccacattaatgatttttgcattaattttaacccctgtttttgtgttattgagtttcgccgataccgctcaattttccgcagtactagaacaagctgaggctgccgtaaataaagatttcacggatttatttacttctaccacaccacttggtttattaagtcttgcggcttggggattaggctatttcgggcaaccgcatattttagcacgctttatggctgcggattctgtcaaatcacttatcaaagcacgccgtattagtatgggttggatggtgctttgcttagcaggcgcaattggcattggcttattcgctattccgtatttctttgccaatccagctattgcaggcacagtcaataatgaaccagagcaagtatttattgaattagctaaacttttatttaatccttggatcgcgggcatattactttccgctattttagccgctgtaatgagtacattaagtgctcaattattaatttcttcaagctcaatcacagaagatttctacaaaggttttattcgccctaaggcttcagaaaaagagctcgtatggcttggcagaataatggtgttagttattgccgcacttgctatctggatcgcacaagatgaaaacagcaaagtattaaaacttgtagaatttgcttgggctggttttggtagtgcgtttggccctgtggtacttttctctcttttctggaaacgaatgacatcatcgggcgcaatggccggtatgcttgtaggcgcagtgacagtatttgcttggaaagaagttgttccagctgatactgattggtttaaagtatatgaaatgatcccaggctttgctttcgccagccttgcaattattgttatttcattactttccaataaaccagaacaagatattcttaatacctttgataaagcagaaaaggcttataaggaagcaaaatga

SEQ ID NO: 2383 - DNA, 966 bp, H. influenzae strain 86-028NP
atgatcgactttcgccctttttatcaacaaattgctactacaaatttatcggactggttagaaaccttaccactccaattgaaagaatgggaaactcaaactcatggcgattatgcgaaatggagcaaaattgttgattttctaccagatttacatgctgatgaaatcgatctaaaaagtgcggtgaaatctgaccgcacttttcccctttcagaaggtgaaaaacaacgaattatccatcatttaaaacaattaatgccgtggcgaaaaggaccttatcatcttttcggcattcatgtagattgtgaatggcgttcagattttaaatgggatcgtgttcttcctcatttagctccactgcaaggtcgcactattttagatgtgggctgtggcagcggttatcatatgtggagaatggtaggtgaaggcgcaaaaatggtggtagggattgatcctaccgagcttttcctttgccaatttgaagctgtacgcaaactgcttaataatgatcgtcgagcaaatcttatcccacttggtattgagcaaatgcaaccattagcggcatttgacactgtattttcaatgggcgtactctatcatcgtaaatccccattagatcatttaagccaattgaaaaatcaattggtaaaaggtggtgaattggtattagaaacattagtggtggatggcgatgtaaatactgtgctcataccagcagatcgctatgcgaaaatgaaaaatgtttattttatcccctctgtcgccgcactaattaactggctagaaaaagttggctttaccaacgtacgttgtgtggatgtagcgacaactacattagaagaacagcgtaaaactgattggttggaaaatgaaagcctgattgattttttagattcaaatgatcacagtaaaaccattgaaggctatcaagcaccgaaaagagcggtaattttagcaaataaataa

SEQ ID NO: 2384 - DNA, 879 bp, H. influenzae strain 86-028NP
atgcaagaacttattaagcgcaccttgccacaagatgatgcacttaatcaagctattgtgaatgaacttcgttcacaaaattgggctggttttttaaattattcccaagtgcagcagctttgtcataattttgaacttaccccactaaaattggctatgcacttgttgccacttgctgcaagttatagtcatactgctatttctcattttaatgtgggggcaattgctattggcgaacaaggggatttttatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatgaattgcacggtgctgaaaaaatttcaattcatttgccgcatagccaaaataatccattacattcttatttaccggatgcgtttgggccaaaagatctcgatattgcagcgcatcttttggcggaagaaaatcatgatttagttgctgatcatcaagatgatttggttaatcaagctattttagcggcaaatcaatctcattgtccttattcaaatagtccgcacggcattgcgattttatttaaaaatggtgatgtggtgacaggacgttatgcagaaaacgccgcatttaatccgagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcagtagaattagagtattattctttgtaa

SEQ ID NO: 2385 - DNA, 483 bp, H. influenzae strain 86-028NP
atgtcaaaaacatcaatcggactagataaagttcaatcagcagaattagccgataaacttaacgaattacttgcaacctaccaagttttctatactaatgtgcggggctaccactggaacattaaaggcgtaaacttctttgcattacacgcaaaatttgaagaaatttatactaatttagttgctagagtagatgaggtggctgaacgtattttaactttaggttacacaccaaataatgcttacagccaatacttaaaaatatctcgaattaaagaagatattgcagtaagtgaggcacaagaatgtttatcaggcacattacaaggtctaaaaacattactagatcaacaacgtgaaattcttgcttttgcaaataacgctaatgatgaaggtactgcatcacaaatgagtgactatattaaagaacaagaaaaattagtatggatgttccaagcagcgtgccaaacttgccataattaa

SEQ ID NO: 2386 - DNA, 1239 bp, H. influenzae strain 86-028NP
atgatttctcaaatagataaagcagaacttttagaacgatttttacattatgtgtcttttcacacccaatcaaaacctaatgcgaagcattcccccagctctgttgggcaaatgaagttagccatgcagttacaaaaagaattaatccaacttggtttggagaatgttgaagtaagtaaatatgcagtggtaacagcatttttacccgctaatgatcctaacttaacgaaaaccattggtttagttgcgcatcttgatacatctccgcaatgtagtggtaaaaatgtacgtccagaagtgatagaagaatatcgtggcggagatattgcattaggtattggcgaggaatttattagccctgtttattattcttttatgcaaaaattagtcggacaaacgcttattgttactgatggaaccactttgcttggggcggataataaggcaggaattgcagaaattatgaccgcactttccattcttcaaaaagagaatattccccattgcaatattcgtgttgcttttacgcctgatgaagaaattggtttgggaatccattatttcccaatggaaaagttttcctgtgattgggcatataccattgatgggggagaggtaggggaattagaatacgaaaactttaatgctgcaacggcaaaagtgcggtttttcgggcgaaatattcacacaggttatgcaaaaggaaaaatgctgaatgcgctgactttagcttgtgaatttcagcaagtttttcctgttgatgaagtaccagaaaaaaccgatgggaaagcgggcttttatcatttagaagatttttctggcgatattgagcaagtagagcttacctatttgattcgtgattttgacgaacagaatttcgcacaaagaaaagcttttattaaaaatcaggtggaaaaatttaatgctaaaaaaggtttgaaaaagcctatagagttagaaattcaagatagctaccaaaatatgtatgatgtggtaaaaaacgttcctcaatcaattgaacttgctgatcgcgcaatgaaagcggtgggaattaaaccaaatcataagccgattcgaggcggtacagatggggcatttttagcctctaaaggtttagcatgcccaaatatttttactggcggctataatttccatagtaaacacgagttggtttctttacaaggcatggaaaatactgtccaagtaattatcgaaatgctgaaatgtaaagatttgtaa

SEQ ID NO: 2387 - DNA, 1146 bp, H. influenzae strain 86-028NP
gtgaaattagggagaaaaccaaagctagtggaaaatcagcctcaaaacaagcctattattgagcttcgttcaatcaaaaaatcctatggttctaacaccattattaacgatttcaatcttgcaattaataacggtgagtttgtcactattcttggcccttcaggctgtggtaagaccacagttttacgcttacttgcaggcttagaagaattggattcaggtagcattattttagatggtgaagatatcaccaatgtgccagcggaaaaacgtcatattaatacggtattccaaagctatgcgctatttccacatatgacaatttttgagaacgtggctttcggtttgcgtatgcaaaaagtaccaaacgaggaaattaaaccgcgtgttttagaagccttgcgtatggtacaactagaagaaatggctgatcgtaagccaactcaactttctggcggacaacaacaacgtattgctatcgctcgtgccgtagtaaataaaccaaaagtgttgttacttgatgagtctttatctgcattggattacaaattgcgtaaacaaatgcaacaagaactcaaaatgttacaacgtcagcttggcattacctttatttttgtcacccacgatcaagaagaagcgattacaatgtctgatcgtattgtattattgcgtaaaggtaaaatcgcacaggatggttctccacgtgaaatctatgaagatccagctaacttattcgttgctcgtttcattggcgaaattaacgtatttgaagccactgtgattgaacgaaaatcagaacaagttgtactggcaaatgttgaaggtcgtatttgtgatatttatacggatatgcctgtggaaaaagatcaaaaacttcaagtactccttcgccctgaagatattgtgattgaagaattagatgaaaatgaacattctaaagcaattatcggtcatattattgaccgcacttataaaggaatgacattagaatcaacggtagagtttgatcataacggaatgcgtgtccttgtaagtgaattctttaatgaagatgatccacatatggatcatagcataggacaacgcgtaggtatcacatggcacgaaggctgggaggttgtactcaacgatgaagataatcaataa

SEQ ID NO: 2388 - DNA, 861 bp, H. influenzae strain 86-028NP
atgaagataatcaataataaattccagaaaattactgttgcgattatcttcagttggctaatcttctttgtgctgattccaaacttattggtacttgccgtaagttttctgactcgagatggtagcaacttttatgcattcccaattactattgaaaactatacaaacttgtttaatccgctttatgcacaagttgtgtggaattcattgtctatgtcgggcatcgccaccattatttgcttactaataggttatccatttgcttttatgatgagtaaaattcatcctaaatatcgaccgctcttattgttccttgtggttttaccattttggacaaactcgttaattcgtatttatggaatgaaagtgtttcttggcgtgaaaggcatacttaacacgatgttaattgatatgggaattttgagtgcgccaattcgtattttgaataccgaaattgcggtaatcattggcttagtttatttactattgccatttatgattttgccactctactctgccattgaaaaactagataatcgtttattagaagcagcacgagatttaggagcaaatacgttccaacgtttcttccgagtgattttaccattgactatgcctggtattatcgcaggttgtttattggtattattgccagcaatgggaatgttttatgtagcagacctactcggtggagcaaaagtcttgcttgttggtaacgtaattaagagcgaattcttaatttctcgtaactggccatttggttctgcagtcagtattggtttaactgttctaatggcattgttgattttcgtgtactaccgcgcgaataaactattgaataagaaagtggagttagaataa

SEQ ID NO: 2389 - DNA, 771 bp, H. influenzae strain 86-028NP
atgagtcgtttactacgtaatgcatttatgtttgtggtatacgcttatttgtatatcccaattattattttagtcactaattcctttaacaaagatcgttatggtttgagttggaaaggttttagctggaactggtacgagcgtttatttaataacgacaccttaatacaagctgcgattcattcggtaactattgcattttttgcggctaccctagctactattgtaggtggattaactgcaatcgcactttatcgctatcgattccgcggtaaacaagcagtaagcggtatgctatttatcgttatgatgtctccagatattgtaatggcagtatctttacttgcattatttatggttgtgggtatttcattgggcttctggtctttactacttgcccacgtaactttctgtttaccgtatgtgaccgtaactatcttctctcgcttaaatggctttgattccagaatgttagaagcggcgaaagacttaggtgcaagcgaagtgactattttacgtaaaattatccttcctttagcattacctgcagttgtatctggttggttattaagtttcactatttcattagatgatgttgtggtttcatcatttgtcagcggtgtaagttatgaaatcttaccattgagaatattctctctagtgaaaactggtgtaacacctgaagttaatgctttagcaacgattatgatcgtgctttcattagctcttgtcgttttaagccagctaattacacgaaaaaataaccattaa

SEQ ID NO: 2390 - DNA, 1167 bp, H. influenzae strain 86-028NP
ttgacgcacaatcaaggcgtttttttatgcctgtcattcggcaggtggtttttttacgactctttaacaggagaacaaacaaaaatgaaaaaatttgcaggtttaattactgccagcttcgtagctgcaactttaaccgcttgcaacgataaagatgctaagcaagaaactgcaaaagctacggctgctgctaatgacactgtgtatctctacacttggactgaatatgtaccagatggtcttttagatgagtttactaaagaaactggcatcaaagttatcgtttcaagcctagaatcaaacgaaacaatgtacgctaaactcaaaactcaaggcgagtctggtggctatgatgttatcgcaccttctaactacttcgtttctaaaatggcacgcgaaggaatgttaaaagaacttgatcacagcaaattacctgttcttaaagaattagatcctgattggctcaataaaccttatgataaaggtaacaaatactctcttccgcaacttttaggtgcgccgggtatcgcattcaataccaacacttacaaaggcgaacaattcacttcttgggcagacttatggaaacctgaatttgcaaacaaagttcagttattagacgatgcgcgcgaagtattcaacatcgctttattgaaaattggtcaagatccaaatactcaagatccagccattatcaaacaagcctatgaagaattattgaaattacgtccaaatgtactttctttcaattccgataacccagctaactcgttcatctcaggcgaagtggaagtgggtcaattatggaatggttcggtacgtattgctaaaaaagaaaaagcacctttaaatatggtattcccaaaagagggtcctgtactttgggttgatacacttgcaattcctgtaacagctaaaaatcctgaaggcgcacacaagctgattaactacatgttagggaaaaaaacagctgaaaaattaaccttagctatcggttacccaacctcaaatattgaagcgaaaaaagcattaccaaaagaaatcactgaagatccagcgatttatccgtcagctgatatattaaaaaatagtcactggcaagatgacgttggcgatgcaattcaattctatgaacaatattatcaagaattaaaagcagcaaaataa

SEQ ID NO: 2391 - DNA, 1944 bp, H. influenzae strain 86-028NP
gtggcattaattagtttaaccaatggatacctttcctttagtgatgcacctttgttggatcacgcagaactacatattgaaccgaatgaacgtgtttgtttagttgggcgtaacggcgcaggtaaatcaactttattgaaaatcatcgcaggcgatgtgcttatggatgatggcaaaatccaatacgaaaaagatcttgtggtttctcgtttagaacaagacccaccgcgtaatgcgcaaggcaatatttttgattatgtcgcggaaggtgtcgggcatttaacggatttattgaaagaatatcatcagatttctgttcaattggaagaaaattacagtgatcaaattttaagtcaattagagcaagttcaggataaattagaacacgctgatggctggcgatttgaaaataaaatcaatgaagtgttgttaaaactaggtttgaatccaaacacaaaattatccgcactttcgggcggttggttacgcaaagcggctctcgcacgcgcattggtatgcgatcctgatgtgttattacttgatgaaccaaccaaccacttagatgtggaagctattgaatggctggaaaatttcttactggatttccaaggtagccttgtatttatttcccatgaccgttcttttattcgcaaaatggcaacacgcattgtggatttagatcgcggtcaattgcagtcttatctaggcaattacgatttatatttaaccacgaaagaagaaaatctacgcgttgaagccttgcaaaatgaattatttgataaacgacttgcacaggaagaagtatggattcgccaaggtatcaaggctcgccgtacaagaaatgaagggcgagtgcgcgcattaaaagcgatgcgtgaggaacgccgccaacgccgtgatgtaatgggaatagccaaattacagttagatacctcaagtcgttctggcaaaattgtctttgaaatggaagatgtgagctatgaaatcgcaggaaaaaccttgttaaaagatttttcaacaacgattttacgtggagacaaaattgcgcttgttgggccaaatggctgtgggaaaaccacgttcattaaattattgctgggtgaaattcagccaacatcaggcaaaatccgttgtggtactaaattagatattgcttattttgaccaataccgtgctgatttagatcctgaaaaaactgtaatggataatgtggcggatggcaaacaagatattgaagtcaatggtgtaaaacgccatgtgctagggtatttgcaagagttcttgttcccaccaaaacgagcaatgaccccagttaaagccttatcggggggagaacgaaatcgtttattactcgcaaaattgttgctccaaccaaataatttattgattcttgacgaaccaaccaatgaccttgatgtagaaacattggagcttttagaagaaattttgacggattatcaaggcacattgttaattgtgagccatgaccgtcaatttatcgataatactgcgacagaatgttatttattcgaaggtgaagggcatttgaataagtatgtgggaggattctttgatgcgaaacagcaacaagccaatttttgggcaagcaaagcggtggaagaacaggctaaggcgaagaaatctgaaccactaaaagaagaaagtgcggtgaaaaatgaccgcacttctaagccgaaatccgtgaaactttcttataaagaacaacgagaactagaacaacttccacaactattggaagagttggaaactaaaatcaccgtacttcaagctgaaatagccgatccagcatttttccaacaagctcacgatattaccgacgctaaattaaaagcattggcagatactgaagccgaattagaaacagcatttttacgctgggaagaattagaagaaaagaaaaatttggctgacggtaaagcttaa

SEQ ID NO: 2392 - DNA, 1386 bp, H. influenzae strain 86-028NP
atgcagaaaaacgaaataaaacaaagcgatatgaaaccacttatcattgattcttcttggacagaacgttttcttcctgatcctccacgcgaaaaagataatcgcccaccatttcgtcgggatcgtgggcgaattttacattctgccgcttttcgttgcttacaagcgaaaacccaaattcacgcaattggcgaaaatgatttttaccgtactcgcttaactcactctttagaagttgcacagattggcagcagcctcgttgcacagcttaaatttttagaaacctttgaaagcctttcgcaaacattaaatattgataaaaacgagttgcaaaaacaattaaaacctttattgccgagtaacgatcttattgagagtttgtgttttgctcatgatattgggcatccgccttttgggcatggtggcgaaacggcattaaattatatgatggcagagcagggagggtttgaaggcaatgcacaaacctttagaattttaacgaaacttgagccttacactgaaaatgcagggatgaatctaacgcgccgaacactattgggtgtagtgaaatatcccgcgttgttaggtgtggcttcgcctcaatatgcagaacttaatttttctcgcaacattgatcctcgttttgtgcgtattcatgattggattccaggaaaaggcattttccgcgatgatttaaaaatgtttaattggttgctggaaaatctttctgaaaatgaccgcactttattctgtcaatttaaaaaagtgcgggaaaatccagctgaatctttacatactcggtttaaatcactggattgcagcattatggaattggcggatgatattgcctatggcgtacatgatttagaagatgcgattgtaactggcgtggtaaatcctcatcaatggcaagcggcacatgttgcattgaaacaaattccgtcagcttggttacatgaaaatattgattcaattagccaacgacttttctcggataaacattttgagcgcaaacaggcgattggtgcattggtgaacttttttattactaatgtgcggtggaaattaacggcaaattttgatgaacctttgttacgttataacgcagagttgccacctgaagtgattgctgcgcttggtgtatttaaaaaattcgtttgggattatgttattcgcaatgtggatacccaacgaatcgaatataaagggcagagaatgctaacagaaatgttccagatttttgaatctgatccggagcgtttattaccaagaaatacagaaaatcgttggcgtaatgcaccaaaagaagggaagaagcgaattatttgcgattatattgcaggcatgtcagatgcacacgcattgcgggtatatcaacaactttga

SEQ ID NO: 2393 - DNA, 696 bp, H. influenzae strain 86-028NP
atgcagcagtacattatttatctttatacatttttaacaattttcgggttttggctcgcactacaaattagcaaacgttggaagtcaatgatttttaatacttttgttttaacagtattaattttggcggcgattttagtgataggaaagattccttatgatgattatatggcaggaaatgcgcctattaataatttacttggcttgagtatcgttgctctcgcattgcctctttatgaacaacttcgccaaattgccagacaatggaaaattattctttcaacggtggttatagcctcttttttggcgatgttaagtggcgggcttttagcatttcttttaggtgcaacgcccgaaatggtcgctacggttttacctaaatccatcacaatgcctattgcgatggaagtttcccgtcatttaggcggcattcctgccgtaactgcagttggtgttgtggttgcaggtttgcaaggatcgatatttggttatcttgtattaaaaaaattgggtgttaaacatcaagaagctattgggctttctgttggttcggtttctcacgcgctcggtacagtaagttgtatggaaacgaatccaacagcgggaagttacagttctatttctcttgtgctttgtgggattattagttctattctcgcgccatttgtatttaagctgatttatttctttgtttaa

SEQ ID NO: 2394 - DNA, 423 bp, H. influenzae strain 86-028NP
atgattcaaaaattatttttattagttcgttcgttggtcattttatctattatgttatatctcggaaatcttattgcttattacattccatcaggtgttccaggaagtatttggggattgttattgctctttttaggtttaacaacacgagtgattcatttaaattggatttatttaggcgcaagtttgctaattcgttttatggcggtactttttgtaccagtgagcgtgggaattatcaaatattctgatttattgatagagcaaattaatattttgcttgttcctaatattgtgagtacttgtgtcactttacttgttataggatttttaggtcattatttgtatcagatgcaatcttttacacataaacgcaaaaaagtaataaaacgtagagaaaatcaggtaaaacaagcgaattag

SEQ ID NO: 2395 - DNA, 483 bp, H. influenzae strain 86-028NP
atgataaatcgaaaaatactattggcgagtttattacttatttttaccgtactttctgcttgttctcgcgaaaaaaatacgtgtcgtgtggttaaaattagtgatggcgatacgctcacttgcctcactaaaggcaataaatccattaaagttcgtttagccgaaattgatgcgccagaaaaatctcaagcctttgggcaaaaatcgaaaaaaaccttgtctgatctggtttatcaaaaaaacgtacgtctttcactaaaaggaaaagatcgctatcaacgaaccttcgcgattgtttattatcaagataaaaatattaatttagaaatggttaaacagggtatggcatgggcttataaacaatattcccatgatccgatttatcttcaagcgcaagaaaatgcacaagccaaaggaattggtctttgggcagataataatccgattgaaccaagtcaatggcgcagacaagagaaaaattaa

SEQ ID NO: 2396 - DNA, 1200 bp, H. influenzae strain 86-028NP
atggcttttgattatcaaacgttccgtcaagaatttccctatttccaacgtgaagattctgttatttatttagataacgccgccaccgcgttaaaacctcaagtgttaattgatcgcaccgctgaattttatgcgtctgcaggttcggtgcatcgcagccaatatgatgctgcccaaactgtgcaatatgaacaggctcgcacacaggttaaagaatgggttcatgcagaagataaacacgctgttatttggacttcgggtacaactcacgcaataaacttagtggcaaatggattgctgccgcaattaaacgccgaagatgaaattctgattagccaagcagatcatcatgccaattttgtcacttggcatgaaacggcgaaaaagtgcggtgcaaaaattcgagttttaccgattttagataattggctaattgatgaaaatgtgcttatttctaccctttctgaaaaaacaaaactcgttgcgctgaattttgtttcaaatgtcacgggcacagaacagccgattaaacgcctgattcaacttattagaaaacatagtcatgcgttggttttagtggatgcagcacaagcgattagtcatattaaaattgatttacaagatttagatgccgatttcctcgcattttctgcccataaaatttatggcccaaatggacttggcgttttaacaggaaaattgaccgcactttctcaacttcaaccgctcttttttggcggaaaaatggttgaacgtgtgtcaaataatcgtattacttttgccgaattgccttatcgtttagaagctggcacacccaatattgctggggttattggctttaatgctgtgctggattggctacaaaaatgggattttaccgcagcagaacagtacgctatatccttggctgaatccgtcaaagtgcggttaaaatcttacgagaattgccgattattcaattctcctcaagcaagcactgtcgtttgctttgtatttgacggcattgactgttctgatctttctacacttttgagcgaacaaaatattgcgcttcgtgtgggcgaacattgcgcccagccttatttagcacgcttaggcgaacgcaccacattgcgtctttcttttgcgccttataatacgcaaaaagatgtagaggcattctttaccgccttagataaagcactggatttattacaatga

SEQ ID NO: 2397 - DNA, 381 bp, H. influenzae strain 86-028NP
atgatagaacaattaaaacaagctaaaaattgggaagatcgctatcgcctgattattcaagcaggcaaaaatttacctcgcccaagcgataatgaactcgctcaaatgcaacctattactggctgcgaagcacaaatgtggtttcaaattatgcctaaacatgaccgcacttttcaattcagcggatttagcgaagccagaattatgaatggcttgctttggattttattcaatcaaatcaatggcaaaacagcggatgaattgaatacatttgatattattgccttttttagcgaactcggcatttcacaacgtttaagtgaaatgcgtttaaacggcttaaaccaaatcagacagcaattaaaaaatttatgtatttaa

SEQ ID NO: 2398 - DNA, 798 bp, H. influenzae strain 86-028NP; identical to SEQ ID NO: 657

SEQ ID NO: 2399 - DNA, 840 bp, H. influenzae strain 86-028NP
atgaattaccaagacaacagcttaaaatccttaaaactcggtcaaaaaacggaatacgcctctcaatatgaccgcactttattacagcctgtgccacgtgcgttaaatcgtgatggattaggcattactcaaaaccaaccatttactatcggcgccgatatttggacggcttatgaaatctcgtggctcaacgaaaaaggcttaccgcaagtggctatcgcagatatttatctggattatcaaagccaaaatttgattgaatcaaaaagttttaaactttatttaaatagctttaaccaaagcaaatttaccgacttcaacgccgttcaacaaactatgcaacgcgatttaatcgaatgtgcgcaaggcgatgtaaaagtgcggttaaatccagtggcagtttatgatgctcaaaaaattgagcatttacaaggcgattgcattgatgaacaagatattgaaattactagctacgaatttaacgctaattggctgaaagattgcgtatcggatgaaattgtcgaagaaaaattagtcagccatttattgaaatctaactgcctcattaccaatcagccagactggggcaccttgcatattcactatgttggtaaaaaaatcaatcacgaaaaattattgcgttacgttatatcgttccgtcagcataatgaattccacgaacaatgtgtcgaacgtattttttgcgatttaatgcactacgcaaaaccagaaaaactcaccgtttacgcacgctatactcgtcgtggcggattagacattaatccattccgctctaattttgagaatttacctgaaaatttaagattggcgagacagtaa

SEQ ID NO: 2400 - DNA, 1125 bp, H. influenzae strain 86-028NP
atggaagtccttaaagatttacgttctgaaattgattcgcttgatcgcgaacttatccaactttttgctaaacgtcttgagttggtttctcaagtcggtaaagtgaaacatcaacatggattacctatttatgcgccagagcgtgaaatagcaatgctccaagcacgtcgtttagaggctgaaaaagcaggcatttcagccgatttaattgaagatgttctacgccgttttatgcgtgaatcctatgccaatgaaaaccaatttggttttaaaactatcaattctgatattcacaaaattgttatcgtgggcggttatggtaaattaggtggcttatttgcccgttatttacgtgcatctggctatccaatttctattttagatcgcgaagattgggcggtggctgaaagtattttagcgaatgctgatgtcgtgatcgtttccgtccccatcaatattactttggaaacgattgagcgactaaaaccttatttaacagaaaatatgttgcttgcagatttaacttctgttaagcgtgaaccgctagcgaaaatgcttgaagttcattctggtgcagttttaggtttacatccaatgtttggtgcagacattgcaagtatggcaaaacaagtggttgtacgttgtgatggacgttttcctgaacgttatgaatggttacttgagcaaattcaaatttggggcgcaaaaatttatcaaaccaatgccacagaacacgatcacaatatgacttatatacaagccttgcgccatttttcgacttttgcgaatggtttacacctttccaaacagcccattaatctcgctaatttattggcgctttcttctcctatttatcgcttagaacttgcgatgatcggtcgcttatttgcgcaagatgcagagctttacgcagatattattatggataagccagaaaatttagcggtaattgaaacgctaaaacaaacttacgacgaagccttaactttctttgaaaagaatgatcgtcaaggttttattgatgctttccacaaggtgcgtgactggtttggcgattattctgaacaattcttaaaagaaagccgtcagctattacagcaggcaaatgatttgaaacaagggtag

SEQ ID NO: 2401 - DNA, 921 bp, H. influenzae strain 86-028NP
atgtctagacctcgtaaacgctggcgtgatgttgatggtgtgtttttgttggataaaccacaaggtatgtcatcaaatgacattatgcaaaaggtgaagcgtttatttcaagcgaataaagcagggcatacaggtgcgctcgatccgttggctacgggaatgttgccaatttgcttgggtgaagcaactaagttttcacaatttttgcttgatgccgataagcgttatcttgttacggcaaaattaggcgaacgtaccgatacttccgatgcggaagggcaagtcgtggaaactcgtgaagttcatgttgaaactccgcaaattttgaccgcacttgaacaatttcgtggcgatattttgcaagtgccgaccatgttttccgcactaaaacataacggtaaaccgctttatgaatatgcgcgtcaaggtattacggttgagcgtgaggcacgtccaattacgatttttgaacttaattttattgaatatcacgcaccttttttaaccttagaagtacattgttcaaaaggcacttatattcgcaccttagtcgatgatttgggtgaagtgctaggttgtggcgcacatgtgacaatgttacgccgtacagccgtagcggattaccccgtagcagaaatgataccaatcaatgagttacaactgctcgctgaaagttttccattaagtgaattagatcgtctattactgccaaccgataccgcagtaagtaaattgcccgctttgcatttggatgtagagcagagtaaagccattggttttggtcagcgagtgaaatttgctaatgaacagcaattaggtggccaagtgcggttattttcagcggagaatttattcttaggcgtggcattaatcgacgggaatattattcgcccacaacggttaattacacaatctgcataa

SEQ ID NO: 2402 - DNA, 387 bp, H. influenzae strain 86-028NP
atggcaagagaatttaaacgtagcgatcgcgtcgctcaagaaatacaaaaagaaatagcagtcattttacaacgcgaagtgaaagatccccgtattgggatggtgacggtttctgatgtggaagtgtcgagcgatttatcttacgcaaaaatctttgtgacttttttattcgatcacgatgaaacggcaattgagcaaggcatgaaaggcttagaaaaagcatcgccttatattcgttcattactaggcaaagcgatgcgtttacgtatcgtgccagagattcgctttatttatgatcaatccttagtggaagggatgcgtatgtcaaatcttgtgacaaatgttgtgcgtgaagatgagaaaaaacacgttgaggaaagcaactaa

SEQ ID NO: 2403 - DNA, 1671 bp, H. influenzae strain 86-028NP
atgcaagcgagacgagacaccaagattgtcgatgaaaatcacacattacaacaagcatttttaaacgatttagacgaaaaactttggtcatctgcggataaactccgccaacaacttgatgccgccaactataaacatatcgttcttggtctcatcttcttaaaatacatttctgataatttcactcatcaacaggaaaaaattcaggcagaactttctgatgctgaaaatcccctctatcttgaccgcactttttttgatactgaagaagaatatcaagaagctttaaccgcagaactagaaaaccgtgattattacaccgcggataacgtattttgggtgcccgcttctgcacgttggcaagccttacaagaagtctctattctcaacactggtgcagaattaccttggggtggtaaattctcaggcgtggcaaaactgattgatgatgcctttgatgccattgaaaaagacaacgaaaaactcaaaggcgtcctccaacgcatcagcggctatgccgtaaacgaagacaccctgcgcgggctgattatcctcttctccgatactaactttacccgcccgacttacaacggcgagcccgtacatttaggtgcaaaagacatactcggccatgtttacgaatacttcctcggtcgctttgcccaagccgaaggcaaacgcggcgggcaatatttcacgccgaaatccatcgtttccctgattgtcgaaatgctcgagccatactccggccgcgtgtatgacccagctatgggcagtggcggctttttcgtgcaaaccgaacgctttattaccgcccatcaaggcaacatcaacaacgtgtccatctacgggcaagaattcaaccccaccacatggaagctcgccgccatgaatatggcgattcgcggcattgattacgacttcggcaaacacaacgccgacagtttcacccagccgcaacacatcgacaaaaagatggatttcattatggcaaacccgccattcaatatcagcgattggtggagcgaatcccttgccgatgatccacgttgggcatacggcacaccacccaaaggcaacgccaacttcgcttggctgcaacacatgatttaccacctctcacccaacggcaaaatggcattattgcttgccaacggctccatgagcagccaaaccaacaacgaaggcgaaatccgcaaagccatcatcaatgccgacttggtcgaatgtatggttgccctgcccggtcagctcttcaccaacacccaaatccctgcctgtatttggtttttaaaccgcaacaaaaaacgcaaaggcgaagtgttgtttatcgatgcccgccaaatcggctatatgaaagaccgcgtattgcgtgatttcaccgctgacgacatcgccaaaattgccgacaccctccacacttggcaaaaatcagacggctatgaagaccaagccgctttctgtaaatccgctacgttagaagagattaaagacaacgacttcgtcctcacaccagggcgctatgtcggcaccgcagaacaagaagatgacggcgtgccatttgcagaaaaaatgcaaaatctgaccgctcttttgaaggagcaatttgcgaaaagtgcggaattggaagcagaaattaagaagaatttagggggattggggtatgagtaa

SEQ ID NO: 2404 - DNA, 1266 bp, H. influenzae strain 86-028NP
atgagtaaaattccattaaatgaatttataactttacagcgtggatttgatttaccaagtaacaaaagaatttcaggaagtgttcccgttgttgcttcaacagggattgctggttatcacaatgaaattaaagttaaagcacctggagttgtaattggaagaagcggaagtattggtggtggacaatatattgaaaaagattttttccctttaaatacaacattatatgtaaaagatttcaaaggacattatcccagatttatttattacttattaaaaagtattgatttcacaagttttaatgtaggaacaggtgttcctacattaaatcgaaaccatttatcaagcattttaatttcagatttgggaattgagaaagaaaaagaaattgccaacatcttaggaagtcttgaccaaaaaatccaactcaacacccaaatcaaccaaaccttggaacaaatcgcccaagccctgtttaaaagctggtttgtcgatttcgacccagtgcgtgccaaagttcaagccctttcagacggcctgagccttgaacaagcagaacttgccgccatccaggcaatcagcggaaaaacacccgaagaactgaccgcactttcacaaacacagcctgaacgctacgccgaactagccgaaaccgccaaagcgtttccgtgtgagatggtggaggttgatggggttgaagtgccgaaggggtgggaggttaaagccttagatgaaattgcaaattatcagaatggtttagcattgcaaaaattccgccctgaagatgacgaaccatttttacctgttgtaaaaattgcccaattgagacaaggttatgcagatggcgatgaaaaagcaaaagcaaatattaagcctgaatgcattattgataatggtgatgtcattttttcttggtctggtagtttattagtagatatttggtgtggaggtaaagctgctttaaaccaacatttattcaaagtctcatccaaagaatatcctaaatggttctattatttttataccaaacatcatttaaccgaatttcagcgtattgcttatgacaaagcagtgacaatggggcatattaaacgtgagcatttatctgctgcaaaatgcatagtgccaaatgacgaattattagcaaataaaacattagaaaatattttagaaaaaattatttttaacaggctggaaaatttcaatcttcaaaacacaagagatttattattacctagattgttaaatggtgaactcaatggatag

SEQ ID NO: 2405 - DNA, 1047 bp, H. influenzae strain 86-028NP
atggatagaactaccgattatttagaacgacttttcattgaggaactaaactctgaaggcgaaattattatcagcggaaacagttttttccgacatgaaattttatatactcttgatcctgaagcatataaagacgtttttgaattttggaaaacagaaagaaaacaaagaaacttaaatgaagccaatagaatattggatattacttcagataatcgaaatcgatttattcgattaaaagaactcttcaaagagaaaaagattatcccctttattggagctgggatgtccatgtctacaggtttaccttcttggagcgaatttcttcgtagtgttcaacaagaaactagaactgatcgtttctattttgaagatctcttatcgcaaggtgaatttgaagaagctgctcagtatctagatgactgtagtccttcacacttacaagagcagttagataatatatttggtagaaaatatctatttaatgaaataaatggtgtaatttgccttttaccaaaattttttaataatactcctattattacaacaaattatgacaatatacttagtactgtttatcaaaaatgcgattacccattttctgatgaactaaatggattatacctagaagacctttataataaacttcttgataaacaaaatttcttattaaagatacatggtacttttgataaaccacaaaatcgaatactaacaaaaaatgactacgataaacactacaatgaccaaactagtaaattgaaaaattgtgtagaaagcttattttcaagttctctattatttatcggttgtagtttaactattgatcgcttaattaaggcgctagccgagattgttcaagaaaaaggcagtgaaaatctacctagacattatgcttttttattttcagatcctaaaaaggacgtgaacagaattaacaaaaaagaagaattagcaaaatccaatatttttccaatttggtatgatggcgatcatgatgaaagcattgaagccttgctggaattattaaatgatggagaacaataa

SEQ ID NO: 2406 - DNA, 3168 bp, H. influenzae strain 86-028NP
atgctcaacgaaaacgacatcgaacaactcacccttcaacgcctgcaatccctcggttgggaatatcgctatggtaaagatttgcctgttcatgagggcgaattttcccgtggcaatttgagcggtgtagtttttattgagcaactgcgtgaggcggtgcgtaaacttaatccgcagctgcctgaaagtgcggttgattctgtggtgaaatccgcgacaaaaagcgatattggcgacttggttgtgcgtaatcagacgttttataaattgttgcgtgatggtgtacgggtagaatatcaagatgatggtgagcagaaaatcgagatggcgcgtttggtggattttgagcatggggaaaacaaccgctttgtcgccgtcaatcagctggaaatccgcagccgtaaaggaggtaaacggattcccgatattatcggctttgtaaatgggctgcctttggtggtatttgagctcaaaaatccgctgcgtgaatcggcggatttattgcaggcgtttaatcagtttgaaacctataaagatgaaattgccgagctgtttgtttacaaccaagccctgattatttcagacggcattgccgcccgtttgggttcgctttcggcagattttcaacgctttacgccgtggaaagtggtcgatgaaaaaaataaaagcgtgcggttatattttgacgatgagttgcaaagcctgctcaatggcttaatgcagcctgaggatttattggactatatccgctatttcgtcttgtttgaacgggattccgttggcaaaaccattaaaaaaatcgcggcataccatcaatattacggcgtaaatgaagcagtagaatccacgatttttgccacaagcgagcaaggcgataaacgcatcggtgtgatgtggcacacgcagggttcgggtaagtcgatttcgatgctgttttatgcaggcaaactgcttgcacagcctgaattgaaaaatcctaccattgtagtggttaccgaccgcaacgatttagatggtcagcttttccaaactttttcttcaggcaaagatttaatcaaacaaacaccgcagcaagtagaagaccgtgatcaactgcgccaactgctcgcacaaaatgaagtcggcggcgtgttttttactacgattcagaaattcgccctaaatgaggaagaaagccgcttccctattttaaatgagcgcaacaatattattgtgatcagcgatgaggctcaccgcagccaatatggctttacgcaaaagctgcataacggcaagtttcagacaggttatgctcgccatttgcgtgatgctttacctaatgcctcgtttattggttttacaggtacgccaattagccttgaagataaggacacgcaagatgtgttcggtcgttatgtgtccatttatgacttgcaagatgcggtggaagatggcgcaaccgtgccgattgtgtatgaagcacgccaaatcaagctagcggagaatgctaatcacgatgaattatttgcagaaattgatgaactgctggaaggcgaagaaaacccgaaattacgcttgcgagaaaaattgctcggctcagaagctcgattgcatgatttagcgatcgattttgtgcaacattttgcaaaacgcaatgaagtggtggacagcaaagcgatgatggtggtttccagccgtcagatttgcgtggatttgtataatcagatcatcgctctgcaccctgaatggcattcggacaatattaacgaaggggcgattaaaattgtgatgacaggttctgcttccgatgcgtctgaaatgcagaaacacgtttacagtaaacaggaaaagcaaacgttagaacgtcgttttaaagacccgaacgatccgctgaaagtggtgattgtgcgtgatatgtggctgacaggctttgatgcaccgtgctgtaacactatgtatcttgataagccaatgaaagggcataacctaatgcaagccatcgcacgagtaaaccgtgtattccgcaataaaagccgagaaaatggcggcttgattgtggattatgtaggcattgctgacgagctcgaaaaagccactcggcaatatacaaactcacaaggcaagggcaaactggctgatagcgtgattgatgtattctttaaaatgaaagagcatttagaagttatccgcagcctgtttgcaacgccagttgaggggaaaacctttgatgttcaggctgccttagaaaaagataatccgaatgatcttttgatggcgattcgttttgccgccaaccatattttaagccttgatcaattatcgtttgatggcaaagcgcacgagcagcattggtttaataaaaaagaaaccgagccacgcaaaaaagcctttttgaaaacggcaggcttggtaaaaaaaggctatatgctgtgcggcacattggctgaagttgagccgtataaccaagaaatcgccttttatgatgccgtacgggcaattttaactaaacgtgaacaaaaaggcacaggcacaaatgaaagacagattttattgaaaaaattggtcaatcaaactgtgtattctgaaggcgtgattgatttattcgatctgctagaaaaaccacaaccacaaatcagtttgctttccgaggaatttttacaaactgtaaaaaatagcccaactaaaaatttatgggttagcgcgatggagcgttatttggcaagtgaaattaaagttaaatcaggcacaaacttaaccttgcaaaaagattttgaacggcgtttgaaggaagcattgaatcaataccacaatcacaatttgactgtggtagagattttggacgaactctttaaaatgagccaagatttccaagaacgtttagcattagggaaaaaactaggattaaccaaggaagaactagccttctatgaagctctatctcaaaatcaaagtgcaaaagatttgatgggtgatgaagtgctttctaaactggcgaaagaaatcacggaaacacttagaaaatcggtcacaatcgactggcagtacaaagaagcggtgcgggcaagaattagattactcgttcgacgtgccttacaaaaatataaatacccgcctgataaacaggaagaagcggtaacttatgtgattaaacaagctgaagaaattgctgaggatttaactggtttataa

SEQ ID NO: 2407 - DNA, 2535 bp, H. influenzae strain 86-028NP
atgactgaagatgttaaggctgatgcgccaaaaaaattaagcattcaacgcagaacaaaaacaacagtgagcagcaccacaactggcggtaaaagcaaagaagtacaagtagaagtacgtaaaaaacgcacagtaaaaactgatattgctcaacaagaagaagcaaaattaaaagcacagcaagaagcggaagcgaaaaaaattgctgaacaaaaagcagcagaagaaaaagctcgtttagaagctgaaaaagcggcaactaagaaagaagctgatgaaaaatcaaaagctgaaaaagcgaaagcagaaaccgctaagccagcaaaaagtgcggtagattctaaagctaaatttgttgatcctgaaaaagagaaacgtaaagcagaagaagctgaacttcgtcgtaaagctgaagaagtggctcgtcaaaaagcagaagaacaagctcgtcgtgcagcagaagaagctaaacgttatgctgaagcagatgattcagacaatgaatcttcttcagaagactattctgattacaatttaagttcaagatatgcacttgaagcagaagatgaagaagatcgtcgtaatgaaaatcgtggtcgaggtaaaaataaagtagcaaaagcaaaaaaaggcggtcgtgacgatgaaaatagcaaaaactcgaaaaacgagcgcgaatctaatcgtaaaaatcaaaaagatgctaagtttggtaaaggtaaaaatggaaaaaaaggcaccgcacttcaacaagcctttactaaaccagttcaagtagtaaaagcagatgttgtgattggcgaaaccattaccgttgcagaacttgcgaacaaaatgtcggtgaaagcgacagaaatcattaaagtgatgatgaaaatgggtgaaatggtcaccatcaaccaagttatcgatcaagaaaccgctcaattagtagcggaagaacttggtcataaagtaattcttcgcaatgaaaatgagcttgaagaagcggtattaggtgatcgcgatgtaaacgcggaaaaagtaacgcgtgcgccagttgtaactattatgggacacgttgatcacggtaaaacttctttacttgactatattcgtaaagcgaaagttgctgcaggcgaagcgggtggtattactcaacatatcggtgcgtatcacgtagaaatggatgatggcaaaatgatcaccttcttggatactccaggacacgcagcgtttacttctatgcgtgcacgtggcgcaaaagcaacagatatcgttgttcttgttgttgcggccgatgatggtgtgatgcctcaaactatcgaagcgattcaacacgcaaaagcagcgggtgcacctttagtggttgcagtaaataaaattgataaaccagaagcaaatccagatcgtgttgagcaagaattattacaacatgatgtcatttctgagaaattcggtggtgatgtgcaattcgttccagtatcggcgaagaaaggtactggggttgatgatttattagatgcaatcttacttcaatctgaagtgcttgaattgactgctgtaaaagacggcatggcaagtggtgtagtcattgaatcttacttggataaaggtcgtggccctgtggcaactatcttggttcaatcaggtacactacgtaaaggtgacatcgtactttgtggttttgaatatggccgtgcgcgcgcaatgcgtgatgaaaacgggaaagaagtggatgaagcaggtccttcaattccagttgaattattaggtctttcaggtgtgcctgcagcgggtgatgaagcaaccgttgtacgtgatgagaaaaaagcacgtgaagtggcattatatcgtcaaggtaaattccgtgaagtgaaattagctcgtcagcaaaaagctaaacttgaaaatatgtttagcaatatgtctgaaggcgatgtggctgaattgaacgttattgtgaaagcggatgtacaaggctctgtagaggcgattgttcaagcgttaaatgaactttctaccaatgaagtaaaagttaaagttgttggttcaggtgtaggtggtattactgaaactgatgcaactttagctaccgcatctaatgccatcattgttggctttaatgttcgagcggatgcaacagctcgtcgtgtcattgaagctgaaaacattgatttacgttactactcaatcatctatgaattgttgaatgaaattaaagcagcaatgagcggtatgttagagcctgaatttaaacaagaaattattggtttagctgaagttcgtgatgtattccgtcatccgaaatttggtgcaatcgcaggctgtatggtaactgagggtgtagtgaaacgtaacaacccaatccgtgtattacgtgacaacgtcgttatctttgaaggggaattagaatctcttcgccgtttcaaagatgatgtatctgaagttcgtaacggtatggaatgtggtatcggcgtgaaaaactacaacgatgtaaaagttggcgaccaaatcgaggtgtttgaagtggttgaggttaagcgttcaatctaa

SEQ ID NO: 2408 - DNA, 1488 bp, H. influenzae strain 86-028NP
atgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacggcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcacgtgaagatatgttaccacgtgaaaacttccgtccgggagatcgtgttcgtggggtgctttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatccagttggtgcttgcgtaggaatgcgtggtgcgcgtgttcaggcaattacgaatgaacttggtggtgagcgtgtagatatcgtgctttgggatgataatccagcacaatttgtgattaatgcgatggcacctgcggatgtttcttctattatcgttgatgaagataatcattctatggatattgctgttgaagctgataatcttgctcaagccattggtcgtaatggtcaaaacgtgcgtttagcaacacaattaacgggttggacactaaacgtaatgacgactgatgagttaaatgctaagcatcaagcagaagataataaagtgttaaatttatttattaacgcattagaacttgatgaagaatttgcacaaatccttgtagaagaaggattcacaagtttagaagaaattgcttatgtgccaatgaatgaattgacagcaattgatggtttggaagatgaagatcttgttgaagagcttcaaactcgtgctaaaaatgcgattacagccgcagcagtagctgaagaagaagcactgaaaaaagcgaatgttgaagatcgtttattgaatttagagggaatgaatcgtcacgttgcaatcaaactagcagaaaaacaaattaccacccttgaagaactcgcagaacaaggcgttgatgatttaactgatattgaagaattaaccgcagaacaggccgcagatttaattatggctgcacgtaatatttgttggtttggcgaagaataa

SEQ ID NO: 2409 - DNA, 456 bp, H. influenzae strain 86-028NP
ttggctacattagaacaaaatttacaagaaatgctacaagatgcggtaaaggatttaggctgtgaattgtggggaattgagtgtcagcgcgtgggtcgttttatgacagttcgtttatttatagataaagaaggtggtgtgacagttgatgattgtgctgatgtaagtcgtcaagtgagcgcaattttagacgtggaagatccaattgcggataaatataatctagaagtgtcgtcacccggtttagatcgtccgctatttaccttgccgcaatttgaacgctatattgggcaagatatcgctgtgcatttgcgaattccagtgatggaacgccgtaaatggcaaggtaagttagagcgtattgaaaaggatatgattactttaatcgttgatgatcaagaacaaattttagtcttcggaaacattcaaaaagcgaatgttgttgcaaaattttaa

SEQ ID NO: 2410 - DNA, 765 bp, H. influenzae strain 86-028NP
atgggatggggtggaattttaggtgcgatgacacaaggattgggaactggtattgtcaaaaatgttgagcaagggtggaaagatgaagaaactcaaaagttgttagattggaaaacggcagaagccgacaaacaacgtgcttttgatagtgaattgcttgataaaaaatacaagcacgagtttgagcttgaagatcatagaacccgtaatgaaatttcagcggcggctgcaaaagctcgaatttcagcacgttattctcatggtggtgaatcagaagcgcaaaaaaatcttcttggcgcaactcaaacgcttggtatttatgatagccaattacattccttgcaagaaaaattgtccgcaacagaagataaagagcaacaaaatgcgattgcagcaagaatcaatgctgtttctgctgaacgcgagaattatcttaaacgccctgatacaatcgctgcatttaagggggctggccagatgggacaagcgctttatatgactggtggtggtaatatggatttgtacaatccgaaaccagtggagcgcgaaacggtagctgaggatgttaaatcttctgtcgctcctcctgtgcgcaatatgattgatgtaaataatctcactccacaacaggcggcagatattgcaagacagaaaagtgaagatgccgctcgtttgcagttttccaaagcgtcagcggatgctaaagactgggcgcaaaaacgtacacagtatcaatcatcaactttcattccgcgaacattctaa

SEQ ID NO: 2411 - DNA, 528 bp, H. influenzae strain 86-028NP
atgggcattttagattcaatgacacaacaatcacaaccgcagacaacagaacaaagtgcggtcgaaaatccacagggttcacaacaacagggaagtatggcgcagatgtatcaaatgttgatgcaaaattccattaatgctatcgcaaatgttgcgcaacaacgtattcaagaaaaaggtcccgaagaaggtattgccgatttagtcgcaaaagcaatgatttcaaatcttcaggccgcgcaacaaaatggaaaaactattccgccgcaagtgatgatgcaagtcgctaaagatttagctatgcaattattacagcaagttggtgtgccagaagagcaaattgatgatgtattgattgatattttaatgaatgcgcttgagcaatttggcgaagcaacgcacggtgcgttacctcaggaagaagaacagcaatacgttgatatgatcaacaaagtatctgaaatggaaagccaacgtcgtgcgcaagtgcaaaacggtcaatcaaaaccaatgcaacaaggggcataa

SEQ ID NO: 2412 - DNA, 1140 bp, H. influenzae strain 86-028NP
atggaaaaagctggctatgagcgagctagtgattctgattcatccttttccggtggaggtggttggcgagaagataacagtagtgatagttatcgtagtacgtcagatagatggaatgaccacaaatctagatacggaaaagacaaagtctatactgatgcatttaatgagcgaagaaataactctagttggagcggtggtcatagcgcaattagccgaacaattagtgaaaaatatcattcactttctaatgggcaaatgagcgccgccgttcctgaaaaagatcagaaaacactcactggcggtttgtttggaaaaagttactccaatgcgccttattctgaacgcactccttctatatttgatagaaacatacgtggttcaatgacattaaataacggcgatgtatggtcaagcgatccccaatattcatccgttcgagaacgggcggacatcaatagttacgaccgtattaaacggggcgaagaattgaacttaattggtcgtgctgtaggaggcgtttttagtggggtgggcggggcagcaacaacgccagttggcaaaattgctgaaagtgcggcaaattttgggctttcccacgttggggatttatctcgacaattcaaaagcaaccaagagcaagcgtattatgatagcctcactccagaggggaaagcgtattacgatacaagagtagatttcatcaataagtcctataagaatgctcgggaaaaatatgaaacgaacgataaatggattgatagaggtattacagctgcacaagtcggtttatctgctttagggcctcctggtgcaatgctagggtctgggattggtttattaggtaaagcgatcaacaaaaaagacacgatgacaaaatcattacgtgatttaacagagacgcttaactctaacgcattaaataaccacatcgcacaacaaaatgaattagctgaaaaagaacgtcaagcctataaggaatttatggctgggcgtgatttacgcagtgacaatacacaaccaaaaggcatactgaacactatgtataatcgtatgcaaaatatagatcctgataaacaggtcaaaacgagtgacgttcctaacctaagaaattattgggcaaatatcatcgtatcatag

SEQ ID NO: 2413 - DNA, 369 bp, H. influenzae strain 86-028NP
atggcgttttgggatggtgcatgggatgcaattagtggcgctggtaaatggctgggggaaacagctggaagtgcaatggattggatggacaaccataaagcagcaagtaatattatcggtaatgttattgctggtgctggtggttactttgcgcaaaaacaagctggtaaagatttgatcaatcagcaacgtgagttattaaatctgcaagatcagatgaaatcaaaatattcagccgtaccagatgcggattggtcgtataaaagtttgacagtggatgattctcctggattggcaaatggcggtattttgactgaaatgaagaaacgttctgaaactaaaggggctaacaatggcagagttgcatga

SEQ ID NO: 2414 - DNA, 822 bp, H. influenzae strain 86-028NP
atgtcaattctaggttctatgacggatgcggtgaataaaactaaaacaccgcaagccccaacaatttccactcaatctccgacaaaagatacatcacagacaatggcaggtaatgtctctaatttattaaatagcaattcacttttaatgaatagcgcggctgctaaaggagaacgtatggcagctaatcgcggcttgcaaaattcaaccattggtgtggaatctgctcaacgtgcaatgcttgatgcggcaataccaattgcaagccaagatacgcaaaatgcgtttgcggaaaaacaaactcgcttacaagctgatttaaatttccaaaaccaaagtaagctcaatcagcaacaaaatcaattcaccgcatcgcaggcagaattagaacgcggtcatcagcgtggaatggcgcaattacaatctgatttagcttatagcaatcaaagtcgattaaatcaggcacaaaatcaattcactgcgtctcaagccgcacttgaacggcaacaacaaaaagatatggcgaatttgaatcatcaaaatgagatgaagaacttaaatgcacaagtggcggcgaacactattggtaaatccattgatttcaccatgcaaatcaccaataactttgatgcgcaaatagccacgatcttgaataactcgaatatgaaagctgaggataaaacaaaggctattgagcagctaaaagcaagtcgagattcagagattcaatttatgagtaagtttatgcagggaattccgaccacgcaacaaaactggtcgtcatttcctagcttaggtgttccgtcaattcaaattagttaa

SEQ ID NO: 2415 - DNA, 504 bp, H. influenzae strain 86-028NP
atgataggcactaaaatctatctcgcattatacaaaggtaaaaaaacgggtaaaaacccgaacgcacttttggcacgtttgagtgactggctcactcgtaaattgacaaaaggcgtgtattcgcattgtgaaattgcagtaatgaaagaagtatttgtcagtgggcatcactatgaaacagaagtgatgtacgagtgttattcgtcttcaattcgagacggtggcgtacgttgcaagcaaattgatgtttatgatagagaaaaatgggatttaattccgctcgacggtgtaaccgaagcacaaatcaaagcctattttgaccgcactttgggctgtaaatacgactggtggggtgctgtcgggattgtgctcggcatcaaacaaaaacgatcaaaatatttttgcagtgaatggtgttttaattgcattaaaaatagcaatgaaggctggcggtttagtccgaatcagcttgctgttgcttttaccaccgtaagtaataattaa

SEQ ID NO: 2416 - DNA, 603 bp, H. influenzae strain 86-028NP
atgaaagtctattttttaaaagaaaatttgaatagttatcaaattttccctattccgcaaaacttaaatgattttgtggaaatggaagtagaaaacgaatcagagcttgagactaaacaacttatttattttaaaagtcaatacattctagttgatagacaaccaacagaattacacaaatggaacggaaacagctggattgtcgatgaaaaaaagaaaactgaaattaagcgtgaactcattaaaaatctagttgatagcattgatgatacagcggcgaacatcagttctagatggataaggtttgccgaagagtataaggagcgagaagctgccgctattgcctttaaagaagcaaattttgctggagaagtaagcgtttatatcagcagttttgcaacggttgcaggtcttgataatcagtctgcgtcacttttgattcttcagcaagcagaaagattacgtgcattgcaacaacaattagcagtgcaaagaatgcgtaagtatgagttaaagcatgaggcgttgagtgatgaagaactgaaaaacattcatgacgatattgtttcaaaaatgcgacaactagcggaggcacaacaatga

SEQ ID NO: 2417 - DNA, 2523 bp, H. influenzae strain 86-028NP
atggcatcacaatattttgcaatcttaaccgactacggaacacgtgctatcgctcacgcattaagccaagggcaaccgttacagctcacccaatttgcagtgggtgatggcaatgggaaagcggtcacaccaacggcgaacgcaacagctctcgtacatcaaacgcacattgcacctgtcagtgccgtctctctcgaccctcgcaataataaacaagtcatcgttgaattaaccatccctgaaaatatcggcggtttttacataagagaaatgggcgtatttgacgcacaaaacaaactcattgcctacgcaaactgtcctgaaagttttaaaccgacagaaagtagcggaagtggtaaagtccaagtattgcggatgatcttaaaagtagaatcttctagtgcggtgacattatctattgataacagtgtgatttttgtcacccgacaacaaatgacaccaaaaaccattactgccacaacgcaaaatggatttaatgaaagcggacacagccaccaaatagccaaggcaagcaccacacaacaaggtatagtccaactcaccaacgacacagggcttgaaagtgaatctcttgcactcaccgcaaaagcagggaaaaaactcgctcaacaaacaacacaattacagttaaatgtctcgcaaaattacatccaaaacagcaaaaaatcctctgcagtaaatagcgaaagcgaagataacgtagcgacaagtaaagcagccaaaaccgcctatgacaaagcagtagaagccaaaactaccgcagatggaaaggttggtttaaatggtaacgaaagcattaatggcgagaaatcctttgaaaatcgtattgtggcaaaaagaaatatccgtatttcagacagccagcattatgcttcacgcggagactatttaaatatcggggcaaacaatggcgattgctggttcgaatataaatcaagcaaccgagagattggcacgcttcgtatgcacgctaacggcgatttaacctacaaacgccaaaaaatctaccacgctggggcaaaaccccaatttaatacggatattgaaggcaagcctaatacacttgcaggctatggtattgggaattttaaagtagaacaagggcagggcgatgccaatggctataaaaccgatggcaattattacttagcaagcggtcaaaatctacccgaaaatggggaatggcatattgaagtagttagcggtggggcaacaaatgcggtgcgtcaaattgcacgtaaagcgaatgataacaaaatcaaaacacgcttttttaatggttcaagttggtcagaatggaaagatgcaggcggcgacggcgtgcctattggtgcagttgtatcattccctcgtgcggtaaccaatcccgttggttttttacgtgctgatggttcaacattcagccaacaaacctttcccgatttataccgcactttgggcaacagcaacaaactccctgatttaacccgtagcgatgtggggatgacggcttattttgccgtggataatatccctgcaggctggattgcctttgacgagattgccacacaagttaccgagcaacgttaccctgagttatatcgtcacttggtcggtaaatatggttctatttcaaatgtgccacttgcggaagaccgatttattagaaatacagggaatgggttaaatatcggtcagacacaaagtgacgagattaaaaagcacgttcacagagtgagaacacactgggctgattcatctgatagtagtattttttatgacaaaacgaaaactgttatagattcacgattatgcactgcaactacaaccgatgataatctcagtgataatggatttatgcatccgcttttagataccccgatggcaacaggtggagatgaaactcgccctaaatcgcttattctcaaactttgtataaaagcaaaaaacacatttgatgacgtgcaattttgggttaaagcattcggcgttgttgagaacgcaggaattttagatgcgggtacacttgtgcaaaatatgcaagcgttatctgcgagggttgaccaagaaataaaagaaaataaacaatctactttacaagaaataaacaatgcaaaagttgatataaatcagcaatttttgcaggcacaaaagaatttatctcaaattggcacattaaaaacagtgtggcaaggtaatgtaagttctgggagtattaatatttcagaaaagtgttttggtaaaacacttattttgtatcttcagtcatcatcaggccacaggcttgatgataataacaatattgaaattgtcagttttgaagtaggggcagagattgaaggtaaaaggggcggtggagtttattttagtagtattcgtcaagtaattccacacagttctggtggaactagtgtgtatcatgtagaagtcgaggaattcgctgtgactgttgatagaaacggtacaacaatacacattgaagaacttgctggtcgttttgtaaaacgtattgatattcgatga

SEQ ID NO: 2418 - DNA, 537 bp, H. influenzae strain 86-028NP
atgattactaatcatttactgccgataggcgcaactccattagaaaaacgtgcggcagaaattctaaaaagtgcggtagaaaatcccattgttattgcagatttaatcaaccctgaacgttgtcccaccgaattactgccttatttagcttgggcgttttcagtggataaatgggatgaaaactggacagaagaagttaaacgcattgcgattaaacagtcttattttgtacacaaacacaaaggcacgattggcgcagtaaagcgtgtggttgagccaataggctatcttattgaactgaaagaatggtttcaaacaaatccgcaaggcacaccaggaacatttagcctaaccgtagaagtgtctgaaagtggcttgaatgaacaaacctataacgaactagtgcgactgattaatgatgttaaacccgtctcaagacatctcaatcagctcgctatcgccctctccccaacagggtcactttgtgcctttgttggtcagcaatggggcgaaatcatcacggtatatccacaatag

SEQ ID NO: 2419 - DNA, 915 bp, H. influenzae strain 86-028NP
atgagcgaattagtcgatttatcaaaactagatgcaccaaaagtgctagaagatttagattttgaaagtttgctcgcagacagaaaagcggaatttatcgcacttttcccacaagatgaaagggcattttggcaagcacgattaagtttagaaagtgagcccatcacgaaattattacaagaagtggtttacttacagttgatggaaagaaaccgcatcaacaatgcggcaaaagccacaatgttagcctatgccagcggttcagatttagatgtgattgccgccaattacaatgtgaaaagacaagtcattcaagaggcgaataataatgttacgcctaaaatccccgaaattttagaagatgacacctcattaagattgcgcacgcaattagcctttgaggggctttctgtggcgggtcctcgctctgcttatatcttccacgcactctctgcacaccctgatgttgcagatgtgtctgtggtatcaccacagccagccaatgtcaccgtcacgattttaagccgtaatggacaaggtgaaacaaacgaaaaccttttaaatgtagttagagccaaacttaatgatgatgacattcgccctattggcgaccgcgttattgtccaaagtgcggtgatccaatcctacgaaatccgcgccaaattacatctttatcgtggccctgaatacgagccaatcaaagctgcagctctaaaaaaattgaccacttacaccgaagaaaaacaccgtttagggcgagatattagcctatcgggtatttatgccgcattacacttggaaggtgtacaacgagtagagcttatctcacctaccgccgaccttgtgctaccaagctcaaaatcagcctactgcacggcaattaatttggagatagtgacaagtgatgattactaa

SEQ ID NO: 2420 - DNA, 339 bp, H. influenzae strain 86-028NP
atgaatcgatacactggcgaaacattaaaaaacgaaagcgaccacattaaacaatccatcgccgatattttgctaacgccagttggttcacgaattcagcggcgtgaatatggcagtttaatcccaatgctaatagaccgcccaattagccacacattgttattacaactggcggcttgtgccgtcactgcgattaatcgttgggaacctcgagtacagatcacacaatttaaacctgaattggttgaaggtggcattgtggcaagttatgtcgcacgcagtcgtaaagataaccaagaaatgcacaacgaaaaactatttttaggacataaacaatga

SEQ ID NO: 2421 - DNA, 600 bp, H. influenzae strain 86-028NP
atgcctatgtctgctgaattacaacgaaaactagacaacattatccgctttggggtaatcgctgaagtgaatcacgccactgcacgagctcgcgtaaagagcggtgacattctgacggattttttacccttcgttacatttcgagcgggtacaaccaaaacttggtcgccgccgacggtgggcgaacaatgtgtgatgttatccgttagcggtgaatttactactgcctgcatattagttgggctttacacacaaaatagcccaagccaatcgcccgacgaacacgtcattgaatttgctgacggtgccaaaatcacttacaaccaatcaagtggtgcattggttgtgacaggtatcaaaaccgccagtattactgccgctaatcaaattgatattgactgccccgctatcaatatcaaaggtaatgtgaatattgacggctctttatcaaccacaggcacaagcaccacaaaaggcaatatcagcacgcaaggcagcgtgaccgcaagcggtgatattaaaggtggctcaattagtttacaaaaccacgtccaccttgaacaaggcgatggccaacgaacctctaacgcaaaggcatag

SEQ ID NO: 2422 - DNA, 429 bp, H. influenzae strain 86-028NP
atgaagattgagttatcgaaacaatttcaagaagggcgtttaaacacgcccttttttaaagacattcaagccatgtcagatgaagaattgcagctcatctttgattttatgcaatccattaaacaagggaaactattaagaggtaaaaataaaccatcttggcttgatgataatctcaatgacattccaaatacagaggtttatcaacaaaacgaaatatggcattatcactgcggcccttacaataaaggatctagatattgtcctatgagtgggctaaaaataaatttgaatggagaaacatcaggacctgtaattcattatcaaaaaatatcagatgaacatatcgtgattatcgctttttctccacaacacgaaccgttcccacgcgaatgggacactccaaacccaatcattgacagagcataa

SEQ ID NO: 2423 - DNA, 558 bp, H. influenzae strain 86-028NP
atgacaaatctatcattaaatcctatttttgaaagttttgcgccaatttttaagcaattaaaaaccgtggcaatgtctgcgttatttattgcgccattggcgataaatcatcctgttcgtcacactacacacacagtcaatattttcagtgttcaaacagatgaaaataaatcgatcaatcaacaagacatagaaaagattattgatatggtgaaagctgtttctgctatcactgattttgttattgcgtcaattacggcagaatcattaagctatattgatttaagtgacgttctgagactagaaagcaaaattaataaatatgatgatctagctaacaatattatggtcaataataaaactccagaattatcaacaacgctacaatcattcagcaataaaatgcacacgctttgcaatatgatgaaatcagaaaaatacaagcaacaatcagatgaagtagtgttatcacgcctttatcgcaaatctgaagatgcagggtacacctacaaatcatcacattcttttgatgattttaaaaaagcagtgatgatgtag

SEQ ID NO: 2424 - DNA, 453 bp, H. influenzae strain 86-028NP
atgctagaacgcaaacatattaaatttgtcgaaatccatcatctttttacgcaaatcagtcttgcattgggatttacagaacaagatattgataaacattcgactaatctcgctgaattaatcgcattatggcagcaacaagaatttgttgaagtttatgttgaaaataaagaccgtctattcggacgtgcaaaagacagcagtttagcctatggtgcatcgccttattatattggtttatatcacgctagattaagttatgaagaaaatgatcctcttgtggtgctaacatttaattatgaagataacccagaacaaaccacagtgtcggttcgttttatggttgatcatgataccttattcgggacaaaagaagaaaaattcattcaacaacgaatgaaagatattcgtaaacgtattgatgattttattcaattaggtaataaaaaataa

SEQ ID NO: 2425 - DNA, 201 bp, H. influenzae strain 86-028NP
gtgctaggatcggcgaaaaataggagggtatcaatgaacgaaaatgcaccttttattcgtgaaattattgaccgcacatcgcaaataaaaggcgaacgtgtgaagggtgacaatgccaaagaaatcaaggcaaatgttcaaaccattttaaaagcacaacttagagccacacaattaaatgctagaacgcaaacatattaa

SEQ ID NO: 2426 - DNA, 1965 bp, H. influenzae strain 86-028NP
atggttactgctgcagcgagaatggatattcaggaaaatgaattagaagattttattcgcttaaatacccaaatggcaacagcatttgatgcagaaaaccccgatgaattagtagagttatttggtaaagtacagaaaaactttaaattaaccaccaaagatgccaaagagctagccgatactattaactatttagatgataatgccatttcaaaggggacagatattattaatttcctaaataacacatcaggaattggtaatttagtcaaaattagtgaaaagaatcttgctgcacttggttcaactttattaacggcaggaaacgaagccagtacatcagccaaagcaatcgaaagtacgttcaaccgtctaagtaaagccactagaatgaaacccgttaataacggactaaaagcgttaggtttagatccaaaagcgattcaaaaagcaatggtaaaagatgcccaaggcacattaatgatgattgttgaaaaaataaaaaaattgcctaaacatttacaggctggcgtaattagcgatattgcaggcggaaattataatacccaattagcagggcttgttgccaataccgaagaatggcgcagacaaattgaactggcaaatagcgaagaagctaaaaatagtatggctagggaatttcaaaccagaatgactactttatcagcaaaatggcaattatttaaaaatcgtttattcaacgtaaatagttctgtaggagccagtttaaaagattcgatgactagcttaatggacggggttggcaatttgcttgataaaatcgagacatggattgatgaacatcctaaattaacctctactatagcaaaaacagcagttgcaatcgggggaagtttaagtctattaggtgcattaagccttgctttaagttttatactttacccagccgcacggctatttttaggcttatccaaattaaacgtaattattcctaaattttcaggacatttatcatctgcagggcggctaatattaagaggattactttctccgctaaaattaattgcactggctatcagtccactagggatagctttattgtccgttgctgcattaatttataaattctggcaacctattaaagccttttttggcggtttttgggagggtttaaaatcaggtctcgcccccgtccttgaaaaattccaaccgctaggcaccgcatttggtgttgtcgtcggttggattgaaaaagcggtgaaatggtttactgatttattgtctccagtacaaagtaccaaagaagatttagatgctgcagtcagtgcaggggaaagattcggaaatggaatggcgaaagcgattgagtttattctgaccccattaacaagattaatggatggtatcaagtggatttctgaaaatatgccaagttgggagggaattaaaaatagtgtatctagtgcatgggaaagaacaaaaaacacttcgagcaacgcttggcaatcaacaaaagaaacggcaggaagtgcttgggaatcatttaaggatttcactggctttggttcaaatggcaaaaaattaccgagtcaaaattggtcaggcggctacactggaaacggtggcaaatatgaacccatgggcattgtccacggtggcgaatacgtgatgaccaaagaagccacatcacgccttggtgtaaatacgctcaacgcccttaattacggcaaacgagcacttattgcgggcggattggggatcagcgttgcaactgccgcccctgtgcaagttgatactcgtgcaccaatttttgctcgtccaatgatgacgcaaaccagccaaccaatgagcgtaaatatcaccatcaatgccgcacaaggcatggacgaacgagccattgcacaacaagtggcaaaacaaatacaacgcattgaaaaccaacgccaagccagagcaagaagttcaatgtgggacagagcataa

SEQ ID NO: 2427 - DNA, 768 bp, H. influenzae strain 86-028NP
atgaaaaatttagagcttacagtcttattaaatgccattgataaaatatctgctccagttcgcagtgcatctaaaagcgttcatgagctatcggcaaaactaaaagaaagcaaatcgattcatcgacaactaaatcagcaaaataagcagcatcaagctgcaatgaaacaatatgcttctgctatcaacccattgaaatcaaaattagattcgctgaatcaagaattagagcaagcaaaacaaaaagccgcatcttatgctcaatatatgaagaacgctcaacatcctactgcaggatttcaaaaggaagtagagaaagcaaaaagtgcggtaaaaaaactcaagcaagaacaaattgatgcagcaaataaattacagcaagcacgccaagaattagcaaaatcaggcatttctgcagaaaaactcgcgcaaaagcaaagggaactacagaaaaacaccaaaagtgcgacggatcaaattaaaaatcaagaagccgcattgaaaaaactcaacgcaaaacaagccgcttataatcaataccgtgggcaagttgagaaacttaaagatatcagtggtaaagcacaaatcattggtgcacaggcaacagctgcaggtacaacaatgactgcaccaattgtcaattccattcgagattttatgtcgtttgaagatgttatggcgggggttgctcgccaagttccagggctaaaagacaaatttgggcaatttacccctaaatacgatgaatggaaaaacaagattaaatag

SEQ ID NO: 2428 - DNA, 339 bp, H. influenzae strain 86-028NP
atgaacaaacttaacagggagagaacgatggaaatttttgttttgctcattggtttgccaattattgttggtttacttattgcatttggtactgcagtattagccgcatttagttatatttttgttggcgcattatctttagcgattaatttctggtatatcacgttagcagtaatgcttgttttgcttgcacctcttatttatttaaatagttggttattttggattttggctgcactcgttattttctttactgttgcttggttttttggtggcgataccgaacaaatcaaagcagaaattgaacgtaaacgtattgctaaagagcataaattgtaa

SEQ ID NO: 2429 - DNA, 183 bp, H. influenzae strain 86-028NP
atgcccttgataaaatgtctgctccagttcgcagtgcatcaatacggtttaacggcacgaccatctaacaataaagatttcaaagtgcaatatgcccagcgtgaattactgggctttgcggaagaagatattgaaatgattgaaagatttgtgcttagagctatagcgggtaaagaattttaa

SEQ ID NO: 2430 - DNA, 348 bp, H. influenzae strain 86-028NP
atgaaaaacaaaagaacatctcgcacgttgatcatgctaaacattgctatgtggagccttgttattatttccacctgtttacattatcaatttaatcctttttcatttatctggtttgatgttatcgcaccagttggtcatttttttgcagtcgttttttctgctttatctagttttactgtttcaatgtatgaactttttaaaccagaaacattttgggggtgggtatggtttgtaatgtttgtcgtgccaatcatttgtttgcctctttatgtggttttattggtattgtttgctggtaaactttcacatcatgatacggtggttccaccttcttatttaaagtaa

SEQ ID NO: 2431 - DNA, 462 bp, H. influenzae strain 86-028NP
atggcaacagtcgaagaagttcaggcaaaattgaccgcacttattgccaatctttctccacaggctcgcagacagcttgggcgaaaaatcgggcaagccttacgaaaaagccaatcgaaccgaattgcacgccaacaaaatcccgatggttcagcctttgaaccgagaaaaccacgtaaagaatttggcaaaaagaaagggcgaatcaaacgcaaagccatgttcgccaaactccgcaccgcccgtcatttaaaagtgcggtcaaatggtaacgaagtttcagtggggtttaatggctcaagtgctgccattgctgcagtgcatcaatatggtttaacggcacgaccatcaaaagaaaaggattttaaagtgagatacgcccaacgggaactattgggcatttcagaacaggatttatcaatgctgaatgaattggtgatagaacaaattagcaaaagctaa

SEQ ID NO: 2432 - DNA, 387 bp, H. influenzae strain 86-028NP
gtggacggtgggcaaatcgtcgcaacgggagccgcatcatttagttttgaatatcgttacacactcaatgttgtagtgactgattatgcaggcgatattgccaccttgattgtgccaatgatggcttacctccgcacaaatcaacctgaaatattagaaaatccacaaattcgagagaacgcatttaaattccagatagattacaacaataacaacaccgcagatattagttttgaaatccaactcactgagcgtgtcgtgtcgaaaaaagacgggaataacgtgcagatccattacgcaaaagaacccgtatgggatgaaccaaaccgagtaaaagtctatttggaaaacagggattcgccaatttttgagggggatacagtctaa

SEQ ID NO: 2433 - DNA, 108 bp, H. influenzae strain 86-028NP
atgacggacactggacatttgattgttgccgtagataaagacaaccgaccattaatttgcagagatacgcaaaatgaaaaagcccaaccaactgcgcaaaatccttga

SEQ ID NO: 2434 - DNA, 123 bp, H. influenzae strain 86-028NP
atgagaagaaccacacttttccttgctatcgctgccgcattgccttgtttagcaaatacctacaccgtgccatttagagatggtccatttgtaaatattcaaattatcctgacggaagaataa

SEQ ID NO: 2435 - DNA, 216 bp, H. influenzae strain 86-028NP
atgacagatcaattcgaccgagcacaacagcttgaagaaatgcaacgcgaaatcgccctcaaaaaacaccgcacttttaaagcagtaagtcgcctttattgtgaagattgtgatgcccccatcccagaaaagcgcagacaaatgattcaaggcgtaacacgttgcgtgacttgccaacaaagatttgaaatacaacaacggaatttcagaaaatga

SEQ ID NO: 2436 - DNA, 351 bp, H. influenzae strain 86-028NP
atgtttaatttcttaaccgccaaagaacgaggcattttccttatcgggccaatactgcttgtactcctcattgtttttctgggatttaaggctaattattggcgaaaagaaatgctcaaagaagaacagctaaaactgaaatggcaaaacgcttacattgagttaaatcatagcgttcaaaattttgccgaacagcaagcacagctaatccaagccgtaaacaacctcaaagcaaaccaaaatcaacaaacacaggatttaaaaaatgtacttaaatcaaaccaagattgggctaaccgccctttgcctgatgatgttaaacgcgtgctcaactcagcaggaagtcattaa

SEQ ID NO: 2437 - DNA, 519 bp, H. influenzae strain 86-028NP
atgattaaacgttccgccaaatacatctgcgccatatccgccgttgttggacttgtgattgcctctcatggaaatgaaattcgaacatccgaaaaaggcttgttactgattggcaatgcagaaggttgtatgaaaaagccctatcaatgccctgccgatgttttaacagtcggcataggcataaccgatgccgttgaaaaaattgaccgcaataaaatttacaccttgcaagaaattgccgaattatacgtaaaaggcattaaacaatcagaaaaatgcgttaatcaatatgccaacgggaaaaccatgccacaaggtgcatttgatgccctcgtctccatcacctttaacgtaggatgcggcaaattaaaaaatagctcactttttaaaatggcacgccaaggctacagcaaagccatgtgcggtcaattcgaacgttggatttatgcagcaggaaaaccgctaaaaggattaattgaacgccgtcaaaaggagaaaaacctatgtttaatttcttaa

SEQ ID NO: 2438 - DNA, 222 bp, H. influenzae strain 86-028NP
atgcacgacgcaccatcaaaagcatcttacacatcaggaatattcgccttcttaattggacgcattgccgatatgttctcaaatgtaaattgggctgatgtcgcatcgattacaggtattgtgattggtgtcgccacctttcttgtaaattggtattacaagaaaaaagattttgaattaaaagaaaaagaactcaaacaacggatccatcatcatgattaa

SEQ ID NO: 2439 - DNA, 210 bp, H. influenzae strain 86-028NP
atgcaagtttacgcacaacaaaatgacaatttagatgccattctttatcgacattttggacgaagtgaaggcttgctcgaaataacatgcgaactcaatccgcatttaatggataagcccattattcccattggtacccctgtcatattgccagatgccgatacagaaaaaatcagtgtagcaaatgacacaattcaactttggagctga

SEQ ID NO: 2440 - DNA, 507 bp, H. influenzae strain 86-028NP
atgagcgacggcgcaatatcagtcaaactggcccctgattatgaaatgggcgaagtgcagcaacagttaaatgattacgatacgtcagatgacattatcagtaatgatggtttcttccccgatatgtcactttcccaatttcgtaatcaataccgtgcagacggcaccattactacacaacgtttacaagatgccttaattgagggcatggcaagtgtcaatgccgaactctccacgtttaaaacgcaaagcaaacgtgacagtttagaacaaatcatcgccccatcaatcaatggcgaaagcgtactgatttatcgctataaacgtgcggtaagttgcttggcactggcaaacctttatgaacgctatgcaagctatgacagcactaacgatggcgaaaagaaaatggcgcaactcaaagacagcattgatgaattacgtcgtgatgctcgctttgcgattagcgacatattgggcagaaaacgcgtcgatgcggagttaatctaa

SEQ ID NO: 2441 - DNA, 651 bp, H. influenzae strain 86-028NP
atgcgcccaactaaacgccactttctggaagtttctgccgctatcgctaatgcggcagaaaccgaagatctaagcgactttacggaatatgaaaaaatgtgccgtattcttgctcgccatcgaaaggatttgaaaaacatccaatcgacggaacgcaaaggcgcatttaaaaagcaaattttgcctgactatctaccatggattgaaggggcgttatcggtcggaagtggtaaacaagataatgtcttgatgacatggtgcgtgtgggcgattgactgtggcgaatatcatctcgccttacaaattgccgattatgccgtatttcatgatttacgcttgcccgagccattcactcgaacacttggcaccttgttagcagaagaatttgccgaccaagccaaagccgcacaagctgccaataaaccgttcgaagtggcttacttagagcaagtccaacgcatcaccgccgattgcgatatgccagatgaaagccgagcgcgattattgcgtgaattgggtttgttattggttgaaaaacaccctgagcaagcactggcatatttagaacgtgctttgggtttagatcaaaaaattggcgtgaaaggcgacatcaagaaactaaaaaaacaattatcagcgactgaatgttga

SEQ ID NO: 2442 - DNA, 1050 bp, H. influenzae strain 86-028NP
atgaataaatttaccaaacaaaaatttaatacttaccttgctggtgttgcacaagataacggcgaagatgttgcttttatcgcaaatggtggtcagtttaccgttgagccaactattcaacaaaaattagaaaatgctgtgcttgaaagttctgatttcttgaaacgcatcaatgtagtgatggtgcaagaaatgaaaggttctgcattgcgtttaggtgtgctttcaccagtggcaagtcgcaccgacaccaacaccaaagcacgtgaaaccactgatattcacagcttgcaagaaaacacctattcttgcgaacaaaccaactttgacacacatttaaattatccaaccttagacagttgggcgaaattccctgattttgccgcacgtgtgggcaaactcaaagcagaacgcattgcattagaccgtatcatgatcggttggaatggcacaagtgcagcaacaaccacaaaccgtacctcaaatccattattgcaagatgtgaataagggttggttagtccaaatcgaagataaagccaaagcccgtgtgttaaaagaaattgaagaaagcagtggcaaaatcgaaatcggcgcaggtaaaacctataaaaatcttgatgcccttgtctttgcattaaaagaagatttcattccagcgcaataccgtgacgatacaaaactggttgcaattatgggtagcgacttattagccgataaatacttcccattaatcaaccaagaaaaaccaagcgaaattttggcaggcgataccgtcattagccaaaaacgtgtgggtgggttacaagccgtatctgtcccattcttcccgaaaggcacagtgttagtcacatcgcttgataacttgtcaatctacgtgcaggaaggcaaagtacgtcgtcacttaaaagatgtaccagaacgcaatcgtgtggaagattatttatcgtcaaacgaagcctatgttgtggaaaactacgaggcagtcgccatggcgaaaaatatcaccattcttgaagcacctacgcctatttcgccagtggctgcataa

SEQ ID NO: 2443 - DNA, 816 bp, H. influenzae strain 86-028NP
atggcaaaaaaatctaaatgggtggttgtggcgacagaaggcgcaaccacagacggacgcactattcagcgcaactggatttcagaaatggcggcaaattatgacccgaaaaaatacggtgcacgcgttaatcttgaacacattaaatggcgttatatgtggaacgatgatccgcactcaaaatgctatggtgatgtgattggtttaaaaacggaagaaaatgctgaaggtaaattgcaattactggctcaaatcgacccaacggacgatttaatcaaactcaataaagaccgtcagaaaatctacacctctattgagtgcgatccaaattttgctgacacaggtgaagcctatttagtcggtttggctgtaacggacaatcctgcaagtcttggcacagaaatgttggtattttctgccggtgcaagcgcaaatcctctcaacaaccgcaaagaaaaagccgataacattttcactgcagccgttgaaactgaattggaatttgtggaagaaacacaaagcatctttgaaaaaatcaaaggcttgtttgcgaaaaaagaaaaatcagacgatgaacgcttttctgatcaaacacaagccattgagcttttagccgagcaaaccaaagaaaccttggaaaaattaaccgcactttctgacgatttagccaaacaaaaagccgaaatcgaagaaatgaaagcaagtaatgcagaaatccaagcaacgttcgcagaactccaaaagcctgttgaacccgaaaatcctcgccctttagtttacggtgaacaacctgaaactgacggccgcttcttttaa

SEQ ID NO: 2444 - DNA, 1782 bp, H. influenzae strain 86-028NP
atggacgaacaagttattaatcaaccttcccccgaagtgacagtggaaatcaaacgtaaagcacagcagatgtatttcagtggttataaaatcgctgaaatttcacgccagttaaatactcctgcctcaacaattgccagttggaaagacagagaaaaatgggacgatattgcgcctgttggtcgggttgaattggcattagagacaagattgaatttgctgattgcgaaagaagaaaagagcggttcagattacaaagaaattgatttgctcggtcgccaaatggaaagaatggcgagagtgaaaaagtattcttttggtgacggtaatgaagtagatttaaacccgaaactggcgaaccgcaacaagggcgaacggaagaaagccgaacccaatgccattgatcaggaacaagaggaattgctgataaatggctttcttgatgggatgtttaattatcaacgtatttggcacaaggcgaaagaacaccgcatcagaaatattttgaaaagccgacaaatcggggcgacttactattttgcccatgaagcctttattgatgctttgacgacggggcacaatcagattttcttatcagccagtaaaaaacaagccttacagtttcgctcgtacattgtgaattacgccaagcaaacggcagatgtagatttaaaaggcgaaaccatcaaattgccaaatggggcagaattgattttccttggcacgaactccgctacggctcaatcctaccacggcaatttgtatttcgatgaagtgttttgggtgcctaaatttgatgtgatgcgaaaagtggcatcaggtatggcagcacaaaaaatgtatcgccaaacttatttttccacgccgaccacaattgcacaccctgcttatgcgttcttttcaggcaaggcgtttaatcgcaatcgtgcgaaatcagaaaaaatcgaaatcgatatttctcacgaaaacttaaagagcggaaaactttgtgccgaccgtcaatggaagcagattgtgagtatttatgatgcaatggaaagtgggtgcaatctattcaatattgacgacctaatcgcagaaaacagcaaagaagaatttgaacaattgtttttgtgtcaatttgccgatgataacagttctgctttcaagttttcggacttacaactttgccaagtggatagtttggaagaatggcacgattataagccattttatcaacgtccattcggcaatcgtgaagtgtggttaggttatgaccctgcttttactggcgaccgtgcagcattagtgattgttgcaccgccgaaagtagaagggggcgattatcgcgttttacataaacaaacttttcacggtatggattacgaaacacaagcaagccgcattaagcagttttgtgatgattacaatgtgactcgcatcgtgattgataaaacgggtatggggtcgggcgtttatcaggaagtgagaaagttttatccaatggcgcagggcctagagtataacgccgatcttaaaaatgaaatggtgttaaaaacacaaaacttaattcagaaacgtcgccttaaatttgatagtggtgacaatgacatcgtgagtagttttatgaccgtgaaaaaacgcattactggcacagggaaaattacttatgtttcggaccgttcggaagatgcaagccacggcgatttatcatgggcaattatgaactgcattttaaatgtgccttatggtttaggcggcgatgtatcaagcaacaaatcaacaatatttacctttgaatag

SEQ ID NO: 2445 - DNA, 1011 bp, H. influenzae strain 86-028NP
atgagcaaaaaaacaaaaaaatccaccgcactttctactggaaatcaagcacaggcgttcagctttggagagcctattccagtgattgaccgtgcagaagtactgaattatttcgaaagcgtggtgatgtatgaaaaatattacaatccgccaattaatttaagttacttggctaaagcgttaaatgcctcagcccatcataacagtgcgattacggtgaagaaaaacattttactttcaacgtgcaaaacaaccgcacttttacctcgaacccaattagaaaaactggtgcaagattacttggtctttggtaatgcttatgttgagaaaactgtaaattcctttggtaaggttgtttcgttaaaatcctctcttgctaaatatatgcgtgtcggtgttgaaacaggtgtgttttatcagattgtgaatggttttgatgaatatgaatttaaaaaaggttctgtctttaacttgattaatcccgatgtgaatcaagagatttatggtgtgccagaatatttggccgcacttcaatctgcttttttaaatgaaagtgccacattgttccgctgtaaatattatctgaatggcgcgcatgcaggttcgattatttacatgactgatccaacacaaaacaaagacgacattgaagcaatcaaaacacaaatccgacaaacaaaaggcactggcaactttaagaatttgtttgtgtatattccaaacggaaagaaagatgggatgcaagttattccattgtctgatgctatcgccaaagatgatttcctaaacattaagaacgcaagccgtgatgatgtgttagctgcgcaccgtgtgccaccgcaactaatgggcattgtgcctaataatacaggcggttttggtgacgttgaaaaggcaacgcgagtgttttttatcaatgagataatcccattgcaagaacgattgaaagaaattaatagttggataggggaagaagtgatcacattctccgattacaaattgctaaattag

SEQ ID NO: 2446 - DNA, 675 bp, H. influenzae strain 86-028NP
atgacaagaattgcaattattcctgcgagagcgggttctaaaggaattaaagacaaaaatttacagcttgtgggtggtgtttctttggtggggcgtgcgattttggcagcgcaagaatcgggtatgtttgatcaaattgtggtgacatcagacggtgaaaatattttaaaagaagccacaaaatacggcgcaaaaccagtggcacgccctgaaagtttggcgcaaagtgatacacgcaccattgatgcaattttgcattgcttagaaacacttaatatttcacaaggcaccgctgcacttttgcaaccaaccagcccattgcgtaatgctttagatattcgtaatgcaatggaaattttccttggcggcaaatataagtcagtggtttccgcttgcgaatgtgagcatcatccttataaatccttcactttagaaggtaccgaagttcagcctattcacgaattaacggattttgaagcccctcgtcaaaaattacccaaatcttatcgtgcaaatggcgcaatttatattaatgacatcgaaagtctctttgaagaaaaacgcttttttattgcgccaatgcgtttttatttaatgccaacttatcgttccattgatattgactccacacttgatttgcaattagccgaaagtttaatttcaaaagaattctaa

SEQ ID NO: 2447 - DNA, 663 bp, H. influenzae strain 86-028NP
atgactcaacttactcgtgaacaagttcttgaactcttccatcaacgcagctcaacacgttattacgaccccgcaaaaaaaatcagtgatgaagattttgaatgtattttagagtgcggtcgattatcgccgagttctgtaggctctgagccttggaaatttttagtgattcaaaataaaaccttacgcgaaaaaatgaaaccttttagctggggaatgataaatcagcttgataattgcagtcatcttgtggtaattctcgcgaagaaaaatgcccgttatgatagtccgttttttgtggatgtgatggcacgcaaaggcttgaacgcagagcaacaacaagccgccctcgcaaaatacaaagccctgcaagaagaagatatgaaattactcgaaaacgaccgcactttatttgattggtgcagtaaacaaacttatatcgcccttgcaaatatgcttactggagcctcagcccttggcatcgattcttgcccaattgaaggttttcattacgacaaaatgaatgaatgcctcgccgaagaaggattattcgatcctcaagaatatgcggtttctgtcgccgcaacctttggctaccgctcacgcgatattgcgaaaaaatcccgtaaagggttggatgaagtggtgagatgggtggggtaa

SEQ ID NO: 2448 - DNA, 1161 bp, H. influenzae strain 86-028NP
gtgattaaatatgtccgacaaatttactctactaaacaggaagttattatggcaacctacttttctgataatttgactgccgaccagcaaaatcaagttcagcagattattcaacaatttcagcatccaactctgcaaaaggatctgattgtgcttaatactttgaaaaaagtggaaaagggcggcgatacgttacgcattgaattgaaattgccttttgcgtggaattctggtgcagaacagttaaaacaagcggtttcagatgcgttattgaaagcaacagattgtaaatcaattaaatgggcggtggcttatcaaatcgccacacttaaacgtgcaaataatcaaccggcagtaaaaggtgtgaaaaatattattgctgtgagttctggtaaaggcggcgtagggaaatcatcggtttctgttaatctagctttagcattacaagcacaaggcgcacgtgttggaattttagatgcggatatttatggcccttctattccacacatgttaggcgcagcgaatcaacgtccaacttcgccagataatcaacacatcaccccaattaaagcacatggtttatctgcaaattccattggctttttaatgaatgaagatagtgcaacaatttggcgcggcccaatggcgagtagtgcattaagccaattattaaatgaaaccctatgggatagtttagattatcttgttatcgatatgcctcctggcactggcgatattcaacttaccttatcacaacaaattcctgtgactggcgcagtggttgtgacaactccacaagatattgctctgcttgacgcagtaaaaggtatttcaatgtttgagcgagtatccgtaccagtgttaggcattgtggaaaatatgtcgatgcatatttgtagtaagtgcggtcaccacgaagcgatttttggcacaggcggtgcagagaaaatggcggaaaaatacaatgtgaaagtattagctcaacttcctctgcatattcgtatccgtgaagatttagatgcaggcaacccgaccgttgtgcgagtgcctgaaaatgaaatttcacaagcgttcttacaacttgcagaaaaagtctctacagaactttactggcaaggttccgtaatcccaagcgagattttatttaaagaagtgaaataa

SEQ ID NO: 2449 - DNA, 2049 bp, H. influenzae strain 86-028NP
atgacaactcaaccccgtaaaattttagtcacttgcgccttgccttatgccaatggggcaattcatttaggccatatgttagaacatatccaagcggatatttgggtgcgttttcaacgtatgcgtggcaataaaatccattttgtctgtgcggacgatgcgcacggcacgccgattatgttgaatgctgataaacttggcattacacctgaagaattaattgctaaagcaaaagccgatcacattcgtgattttgcaggtttcaatattagttttgataactatcattccactcacagcgaagaaaacaaacagctcactgcagaaatttacaataaactcaaagccaatggctttattaagagtaaagttatttctcagttattcgaccctgaaaaaaatatgttcttgcccgatcgttttgtgaaaggcacttgcccgaaatgtaaagcagaagatcaatatggcgataactgcgaagtttgtgcttctacttacagcccaatggatttaattaatcctcgttcagctgtttctggcacaacacctatcgtaaaagaatctgaacactttttctttgacttgcctgcatttgaagggatgttaaaagaatggactcgttctggctcacttcaatctgaaattgcgaacaaaatgcaagaatggtttgagagcggtttacaacaatgggatatttcacgtgatgcaccttatttcggttttgaaattcccggcgcaaaagataaattcttctatgtttggttagatgcgccaatcggctatatggcttcattcaaaaatctatgtgagcgtgaaggcattgatttcaacgaattttgggctgaaggcagtgatgcggagctttatcatttcatcggtaaagatatcgtttatttccacagtctattctggcctgcaatgcttgaaggcagcggctatcgtaaaccgactaatgtgttcgctcatggctatgtaacggtggatggggcgaagatgtcaaaatctcgcggcacattcattcaagccagcacttatttgaatcatatcgatcctgaatgtttgcgttattactatgcagcaaaattaaatgatcgcattgaagatttagactttaaccttgaagatttcgtacaacgtgtaaatacagatatcgtaaacaaattagtgaatttagcttcacgcaatgcaggttttattgcgaaacgctttgaaggcaaactttcggataaactggaagacgaagcattatttgcagaatttaccgctcaagccgagcaaatcgctgcttattacgaaagccgtgaatacaataaagccattcgtgaaattatggcattaacggataaagccaataaatacattgatgaaaaagccccttgggtgattgcaaaagaagaaggcaaagaggcagaattgcaagccgtatgttcaatgggtattgagcttttccgcgtattgatgtcttacttaaaacctgttcttccaaaactggcagaacgtgcagaagccttcttacaagctgaattacgttgggataatattcatcaaccattacttggtcatacccttgcaccgtttaaagccttattctctcgtttagagaaaaaacaaattgatgccgtagtggaagaaactaaagccttatttgccgcagccaataaagcagcagaaaaaacagaagcaaaaccaaccgcactttctgccgttaaacctattgctgaaaccatcacgattgatgatctcgctaaacttgatatgcgtgtagcaaaagtactgaaatgcgaagcagtgccagaatctaataaacttttacgttttgaattggatcttggcgatcatactcgtcaagtcttctctggcattaaagcggcttacaataaacctgaagaattagaaggtcgttttgtgattatggtggcaaaccttgcaccacgtcaaatgaaattcggcgtgtctgagggaatgattctatccgcaggaacaggcggtagtgatttattcttgttatctgccgataatggtgtcaccgcaggtatgcaagtaaaataa

SEQ ID NO: 2450 - DNA, 861 bp, H. influenzae strain 86-028NP
atgaaaaacgaattaatctgctataaacaaatgccagtgtggacaaaagacaaattgccacaaatgttccaagaaaagcacaacacaaaagtcggcacttggggaaaattaaccgtattaaaaggtaagcttaaattttatgagctaacagaaaatggcgatgttattgccgagcatatttttaccccagaaagccacattccttttgttgaacctcaagcatggcatcgtgttgaagctctttctgatgacctagaatgtaccctaggtttctattgcaaaaaagaagattatttcagtaaaaaatacaacatgactgccattcacggcgatgtggtggatgcagcaaaaattatctcgccttgtaaagtattagatttaggttgcggacaagggcgtaattcactttatttaagtttattaggctatgatgtaacctcttgggatcacaatgaaaacagcattgcctttttaaatgaaaccaaagagaaagaaaaccttaatatttctaccgcactttacgacattaacgccgccaacattcaagaaaactatgattttattgtttcaacggtggtgtttatgttcttaaatcgtgaacgtgtgccgtcaatcatcaaaaatatgcaagaacataccaatgttggcggatataatttaatcgttgccgcaatgtccacagatgatgtgccttgcccacttccattctcattcacttttgctgaaaacgaattgaaagaatattacaaagattgggaattcttagaatataacgaaaatatgggcgaattacacaaaaccgatgaaaacggcaatcgcattaaaatgaaatttgccaccatgttagcgagaaagaaataa

SEQ ID NO: 2451 - DNA, 702 bp, H. influenzae strain 86-028NP
atgttatttgctttacctgcgctgaatgataactacatttggctttatcaacgagaaaatctgccgcttattattgtcgatttgcctgaaacggacaagctgtttgcatggctagataagcaaaacgcaacgattgaagcggtgttgcttactcacgaacatgaggatcatacacaaggtgtgtcggcatttaaaaaacgttatccaacagtgccgatttatgggccgcaagaatgtgagaaaaaaggtgcgactcaagttgtgaacgaagggaagatccttaccgcacattatcaaattgatgtcattccgacggggggacacactaaacagcacgttagttttttagtggataatcatttattttgcggtgatgcgttattttctgcaggttgcggacgtgtttttacaggcaattatgcgcagatgtttgatggtttgcagcgtttgaatacattgcctgacgagacgattgtttgcccagctcatgaatataccttggggaatttagcatttgcggaaactgtgctggtggaaaaaagtgcggtagaaaaacaacgtatttttgttgaaacacaacgggctgaaaataaaccaagtttgccgacaaccttaaaacttgagcgagaaattaatccgtttttacaagcaaaaacacttgaagaatttaccgcacttcgcaaagctaaagatattttctaa

SEQ ID NO: 2452 - DNA, 807 bp, H. influenzae strain 86-028NP
atgactatttacgacatcaattttgctgaactgtatcaacaacacttaatcgcttgtcatcattacaacttacctccgacaaaatgggataaaaaagccgtgaaaatggcagaaaatttggtcggtaagccttcagcatataatcagcaattattgcaagcaatgaatgtgcaaaccgatgaaacagtgttggatattggctgtgggcctggtacttttgctgtaccgctcgcacaacaaggttcaacggtatatgccttagattatagtaatggaatgttagattgcttggcgcagttcaaacagaaattggggttgcataatctcacaacatttcataaatcttggacggataattgggatgatgtgccacaagctgatgtagtgttggcatctcattcaacgttggtggacgatttggacgatatgatcgaaaaactctgtgccaaagcgaaaaaacgtgtgtttttgacttctgtcacacaacgccatttcttagatgagggcgtatttgaggcaattggccgtgaagatattggtttccccacttatatttatttactcaatcggttgtatcaaaaaggcattcaggcaaatttgaattttattgaaacggaatcgggttgttttcaaggtgaaatctacgaggatttattagcctcggtggaattttctttaggcgaactgtccgaaaaagaaaaacaaggtttgaaagccttttacgatcgtaaacaagccaataacgaactaatttttcatggacagaaaaaatgggcgttgatttggtggaatgtggatcgcatctaa

SEQ ID NO: 2453 - DNA, 477 bp, H. influenzae strain 86-028NP
atgaaatttgaagtaatttataaatttttcttagtgtggggactagccttaagtttgcttttcgttgttgcaagtggcatttcaatgtggctaggatttccttttagtcaagccttagacattcatcttttctttgctggatttaccgtatttggtttgttactgcatttttatagccgtaagaagaaatgggtaaaaatcaacactcaatttgccgatctcatcacaaataatcgcatgccttcttactgcaatttagatcgcttgatgatgactttcgaacatttctctattcaacaaatcgccgagcaacttaatctttctctcccgattttattaaatgaattatcgcaagctcaaataaacataactgattcccaccgcactttatgcgaaaactttcctctcaacgatgaaaaaattttcgccgcaattacaattgccttaaaagtgcggttcaatccaactttactttaa

SEQ ID NO: 2454 - DNA, 1764 bp, H. influenzae strain 86-028NP
atgacagaacaaacctttattctcggcaaagatgctgcattagaagatagtattgcaaaatttcagcaaaaattgaccgcacttggttttaatattgaagaggcatcttggttgaatcctgtgccaaatgtgtggtctgtgcatattcgcgataaagactgtccgcagtgtttttctaatggtaaaggggcaagtaaaaaagcggcgttagcctctgcccttggcgaatattttgagcgtctttctactaattatttctttgccgatttctatttaggacaagaaattgcaaacggcgatttcgtacattatcccaatgaaaaatggttcccaattgaagacgatgctttactgcctaatggcattttagatgattatttattggattattttgatcccaatgccgagcttacgcctgaattattaatagatttacagtctggcaattatgatcgtgggatcgtggcgatgccttatgttcgtcaatcggacgaacaaaccgtttacattccacaaagtattattgccaacctttatgtctcaaatggcatgtctgcaggcaatacgaaatttgaagcacgcgtgcaaggcttgtcagaggtatttgagcgttatgtgaaaaacaaaattatcgctgaagcaattagtctgccagaaattccaaaatctgtgatggatcgctatccatctattcaggcttccattgcaaaattagaggaagaaggtttcctaatttatgcatttgatgcttcacttggcggaaaataccctgttatttgcgttgtgctactcaatccgaataacggtacttgctttgcctcttttggtgcgcatccaaatttccaagtggcattagaacgtactgtgacggagcttttacagggtcgtagcttgaaagatttggatgttttctctccgccctctttcaataacgatgatgtggctgaacacgctaatttagaaacccactttattgactcaagcggtttaatttcttgggatttactcaaaaaaacgcctgattatgaatttgctgattgggatttcagtggtaccacgcaagaagaatacaataatttaatggcgattttccgtgccgatgaaaaagaagtttacgtaatggattacaaccatttggatgtctatgcgtgccgtattattgtgccaggtatgtctgatatttatcctgcagacgatttaatttacgccaataacaatatgggaatggattggcgcgaaattttactggatttaccaaactggcatcacgatgcagaaacctatcaagaattattagatgaattagacggacaagatattgacgatgcgactcgcgtgcgtgaatttatcggcatcgttgcacctaaaaatagcggctggacaactttacgcgtcggtgaattaaaatctatgctccaccttgcattaggcgaattagaacaggcattagattgggcaaactggacgctgaatatgaacagttccgtatttaccacagaacctgtgaattattaccgcgcattaatttccatcattgaattacatttagatcaaaatcgtgaaccagcgcaatatcgtgcagtgtttgagaaaatgtatggtaaagatgcagttaaacaagcttgggcagctgtctctgaaggtggcaatccgttctacaatcttccagcaagtgatgaaaatttggaaaactttaaggaacatcaggcgttgttgggggcttatgggaagttgcagaaagcaaagcgagcacatcaaaaataa

SEQ ID NO: 2455 - DNA, 2643 bp, H. influenzae strain 86-028NP
atgacggattcaatccaatcatctatcacccctgtcaatatcgaagaagaacttaaatcttcctaccttgactacgcgatgtcggttatcgttgggcgtgcattacctgacgttcgagatggtttaaaaccagttcaccgccgcgtactgttctcaatggatcgcgaaggcaataccgccaataaaaaatacgtaaaatcagcgcgtgttgtgggtgatgtaatcggtaaatatcacccgcatggtgactcagccgtgtacgataccatcgttcgtatggcacaaccattctcacttcgctatatgttggttgatgggcaaggtaactttggttcaattgatggtgatgcgccagctgcaatgcgttataccgaagtgcgtatgcaaaaaattacgcaagcattgctcactgatttggataaagaaaccgtcaatttctcgccaaactatgatggcgaattaatgatcccagatgtattgccaactcgtattccagcacttttagcaaatggttcttctggtattgcggtggggatggcaactaacattccccctcacaacttaaacgaagtattaaatggttgtttggcttatattgacaacaatgaaattaccattgatgaattaatgcaacatattccgggcccagactttccaaccgctgcattaattaatggtcgtaaagggattgaagaagcctatcgcactggtcgtggtaaagtttatgttcgtgctcgtgcaaccgtagaaaccaacgaaaaaggacgcgagcaaattatcgtgtctgaattgccataccaagtaaataaagcaaaattagtcgagaaaattgccgaattaattcgcgagaaaaaaatcgaaggcatcagcaatattactgacctttcaaacaaagaagggatccgtattgaaattgatattaaacgtgatgcagtgggggaagtggtattaaaccatctttactcactcactcaaatgcaagtgacctttggtatcaatatggtggcattggatcacggtcagccacgtttatttaatcttaaagaaatcattgaatccttcgttttacaccgccgtgaagtggtgacacgtcgttctatctttgagcttcgcaaagcacgtgaacgtacgcacattttggaaggtttagcggttgctcgttctaatatcgatgaaatgattgcaattattcgcaactctaaaaaccgtgaagaggccgcaacagcaatcagttcacgttcttggacattacatagcgatattattaatcttcttgatgtttccgctcgtcctgatgagttagaagaaaatcttggtattcaaggtgaacagtattacttatcgccagcgcaagtaaacgcaattctagaacttcgcttacaccgtttaacgggcattgcgtttgaagaagttataaaagaatatgaagaattattagttaaaattgcggatcttcttcatattttaagtagcgcagaacgtttaatggaagtgattcgtgaagaattagaagaagtgaaagcacaatttggcgatgatcgtttaactgaaattaccgctgcttctggcgatattgatttagaagatttaatcgcacaagaagacgtggttgtgacgctttctcacgaaggttatgtgaaataccaaccactgactgactatgaagcacaacgccgtggcggtaaaggcaaatctgcaacgaagatgaaagaagaagatttcatcgaaaaattactggtggcaaatactcacgataccatcctctgcttctctagccgtggtcgtttatattggttgaaagtatatcaacttccacaagcaagccgtggtgcacgcggtcgtccaattgtgaatattcttccgttacaagaaaacgaacgtattactgcaatcttgccagtttctgcttacgaagaagataaattcgtagtcatggcaactgctggcggtattgtgaagaaaatcgccttaaccgaatttagccgtccacgttcaaacggtatcatcgcattgaatttacgtgacgaagatgaattaatcggcgtggatattactgatggcagcaacgaaattatgttgttctcatcgcaaggtcgcgtggtgcgttttgctgaaaatgccgtgcgtgcaatggggcgtttagcaacaggtgttcgcggtatcaaactggctttaacaaacgatatttctgacgatgaaagtgcggtagaaattgaagatatttctgatgacaacgctgaagcatcattagacttaaatatcgataaagtggtttctctcgttgtgccaaaaggtgaaggggaaattttaacagcaacacaaaacggctacggaaaacgcacacaattaagtgaatacccaactaaatcacgtaatacaaaaggtgtgatttcgattaaagtgagtgaacgcaatggtaaagtcgttgctgcaactcaagtagaagaaacagaccaaattatgttgatcactgatgcaggaacgcttgttcgcacacgcgtaagcgaagtgagcattgtagggcgtaacacgcaaggtgttcgcttaattcgtactgccgatgatgaacacgtagtaagtttagaacgtgtttgtgatgcagatgaagaagattctttggaagaaagcagttctgaagaataa

SEQ ID NO: 2456 - DNA, 1077 bp, H. influenzae strain 86-028NP
atgtctgtgcaaaatgtagtgctttttgacacacagcctttaactctgatgcttggcggcaaactttcccatattaatgtcgcgtatcaaacttatggcacactcaatgccgaaaaaaataatgcggtattaatttgccatgctttgactggcgatgctgagccttatttcgatgatggtcgagatggctggtggcagaattttatgggagcaggtttagcattggatacggatcgttatttttttattagctcgaacgtattaggtgggtgtaagggaacaactgggccttcatcaattaatccgcaaacgggtaaaccttatggcagccaatttcctaatattgttgtgcaagatattgttaaagtacaaaaagccttgcttgaacatcttggtattagccatttaaaagccattattggtggatcttttggcggtatgcaagcgaatcaatgggcgattgattatcctgattttatggataatatcgtgaatctttgctcatccatttattttagtgctgaagccataggctttaaccatgttatgcgtcaagcggtaattaatgatcccaattttaacggcggcgattattatgaggggacaccgccagatcaagggttatctattgcgcgtatgctaggtatgctgacttaccgcaccgatttacaactagccaaagcctttgggcgtgctacaaaatcagatggcagcttttggggcgattactttcaagtggaatcctatctttcttaccaaggcaaaaaattcttagaacgttttgatgccaatagttatttgcatttgttacgtgcgttggatatgtatgatccaagtttggggtatgagaatgtcaaagaggcattatcacgtattaaagcacgctatacgttggtttctgtgacaacggatcaactttttaaacccattgatctttataaaagtaaacagcttttagagcaaagtggagtcgatctacatttttatgaattcccatcagattacggacacgatgcgtttttagtggattatgatcagtttgaaaaacgaattcgagatggtttggcaggtaattaa

SEQ ID NO: 2457 - DNA, 735 bp, H. influenzae strain 86-028NP
atgcgattcacaaaatccatcaaattctccttgaagtgcggtcgatttttcattatgtttaccgctatgctagtaaaaaaattatctccaaaattcaccgtactttttcgcgcactactctacgcaatctttgcattgattatactttgcttgctagtggatcgaggcgtcagtttttatgttcgcgataaaatattcacaaatattgatgaactcccctttcgcccctgcgcccttgtgcttggcacatcaaaatacaccgtcagcggaaaaccgaacgtttattacgatagtcgcttaatggcagctaaaagcctaatcgaacaacaaaaagtgaattatcttttattaagtggtgacaaccgaactttgcaatataacgaaccaagagcaatgtttcgcgatttacgcaaaatgggcgtgccagaaactttaatgttccgtgattttgcaggttttcgcaccctagattccgttatccgcgccgataaaattttccaagtgaaaacatttacgattgtcagtcaaaaatttcattgcgaacgcgcgctattaattgcccaagcacataatattgatgccatttgctttgtggcaaaacagccagaattacatttttccacacaaataagagaagtttttgcccgcataaaagcggtttttgacttgatattaggtgttgagccttattttttaggggaacctcagccattgccaaacagcaccacattataa

SEQ ID NO: 2458 - DNA, 1314 bp, H. influenzae strain 86-028NP
atgaataatatgcaacttaaagccacttcgccactcgctgagtggctttcttatttagaaaaaagccattttaaacctattgatctcggtttagatcgtattcaatccgtggcagaaaaattggatttacttcatcccgccccttatgtgataactgtgggggggacgaatggtaaaggcacgacttgtcgcttgttagaaacgattctgcttaatcacggattacgtgtaggcgtgtattcttcgccccatttattgcgttataacgagcgagtacgcattcaaaatcaagatttacccgatgaagcacataccgcctcttttgcttttattgatgaaaacaaaacagaatcgctgacttattttgaatttagcaccctttctgcattgcatttatttaagcaagcaaaattagatgtggtgattttagaagtgggtttgggcggccgtttagatgcgaccaatattgtggatagccatcttgctgtgattactagcatcgatattgatcacaccgattttcttggggataccagagaggccattgcttttgaaaaagcaggaattttccgcgaaaattgccctgtcgtgattggtgaacctaatgtgccgcaaacaatgttagatcaggccgaaaaattacattgccaagttgctcgtcgtgatgtggattggttatttgagcaaaatgctgaaaattggcaatggcaaaataaaaaagtgcggttagaaaatttgccgttttgtcagattccattggcgaatgccgcaacggctctggctgccgttcaatatttaccttttgatatttcagaacagactttgcgaaaatctttgcaagaggtagaactggttggtcgttttcaagctataaaaacagataaacgtgaaaaattagcggattatcttggcgtaccagttgaaaccttgccaacaattatcgttgatgtagggcataatcctcacgctgcaaaatatttatctgaaaaattgaccgcacttaaacgtagcatcgagggtaaaatgattgccgtgtgtgggatgctcaaagacaaagatgcaaatggggtatttgagcatttaacacctattattgatgaatggcattgtgtaactttaggcggctatcgcgggcagtcaggcgatgaattagcagagaaattgaaaagtcatttcccaaatattcaagctacatcagataattctgttatggatggtgtgtgtacagcactcaaaagtgcggtaaaaaatgatgtggttttagtctttggatctttccacaccgttgctgaattttgggctgtggtggaataa

SEQ ID NO: 2459 - DNA, 891 bp, H. influenzae strain 86-028NP
atgagctggattaaccgaatttttagtaaaagtccttcttcttccactcgaaaagccaatgtgccagaaggcgtgtggacaaaatgtactgcttgtgaacaagtactttatagtgaagaactcaaacgtaatctgtatgtttgcccgaaatgtggtcatcatatgcgtattgatgctcgtgagcgtttattaaatttattggacgaagattcaagccaagaaattgcggcagatttagaaccaaaagatattttaaaattcaaagatttaaagaaatataaagatcgtatcaatgcggcgcaaaaagaaacgggcgagaaagatgcgctaattactatgacaggtacactttataatatgccaatcgttgtggctgcatcgaactttgcttttatgggcggttcaatgggttctgtagttggtgcaaaatttgttaaagcggctgaaaaagcgatggaaatgaattgtccgtttgtatgtttctctgcgagtggtggtgctcgtatgcaggaagcattattctctttaatgcaaatggcaaaaaccagtgccgtacttgctcaaatgcgtgaaaagggtgtgccatttatttcagtattaacggatccgactttaggcggcgtatcagccagttttgcgatgttaggggatttaaatattgccgagccaaaagccttaattggttttgcagggccacgcgttattgaacaaactgtgcgtgaaaaattgccagaaggtttccaacgtagtgagtttctacttgagaaaggggcaattgatatgatcgtgaaacgttcagaaatgcgtcaaactttagcaagtgtactgagtaaattaacgaatcaaccttctccttttgtagaacctgaactcatttcagaagatgaataa

SEQ ID NO: 2460 - DNA, 1392 bp, H. influenzae strain 86-028NP
atgaaaaaaacacgttttgtattaaatagtattgcacttggattaagtgtattaagcacatcatttgttgctcaagccactttgccaagttttgtttcggaacaaaacagtcttgcaccgatgttagaaaaagtacaacctgccgttgtcactctttccgttgaaggaaaagctaaagtagattctcgttctcctttcctagacgatattcctgaagaatttaaattcttctttggcgatcgttttgccgaacaatttggtggacgtggagagtcaaagcgtaacttccgtggtttaggttctggtgtcattattaatgcaagcaaaggctatgttttaaccaataatcatgttattgatggagctgataaaattaccgtgcaattacaagatgggcgtgaatttaaagcaaaattagtgggtaaagatgaacaatcagatattgcattagtacagcttgaaaaaccaagtaatttaacagaaatcaaatttgctgattccgacaaattacgcgtaggcgatttcactgttgcaatcggtaatccatttggtttaggtcaaactgtgacatcaggtattgtttctgcattgggtcgttcaacaggttctgacagtggcacttatgaaaactatattcaaaccgatgcagcagtaaaccgcggtaattcgggtggtgcattagtcaatctaaatggcgaacttattggaattaataccgcaattatttctccaagcggtggcaatgcaggaattgcctttgcgattccaagtaatcaagcaagcaatttagtgcaacaaattttagaatttggtcaagtgcgtcgcggattgcttggtattaaagggggcgaactcaatgctgatttagccaaagcctttaatgtaagcgcgcaacaaggcgcatttgtaagtgaagttttaccgaaatctgctgctgaaaaagcaggacttaaagcgggcgatattatcacggcgatgaacggtcaaaaaatctcaagtttcgctgaaattcgtgcaaaaatcgcaaccactggtgcaggcaaagagattagcttgacttacttacgtgatggcaaatcccacgacgttaaaatgaaattacaagcggatgatggtagccaactttcctcaaaaactgagttgcctgcattagatggtgcaacattgaaagactacgatgctaaaggcgttaaaggaattaaaatcacaaaaattcaacctaattcgctggctgcacaacgtggtttaaaatcgggcgatattattattggtattaatcgtcaaatgatcgaaaacattcgtgaattaaataaagtgcttgaaactgaaccgtcagcagttgcacttaatattttacgaggtgacagtaatttctatttattagtgcaataa

SEQ ID NO: 2461 - DNA, 3441 bp, H. influenzae strain 86-028NP
atgaaaacggcttttttccaacctgatattccaacccaacccaatgatcacaaaattttaggcaatgtattaccaggcgctgatgcattggcgattagtgaaattgcagagcaaaaccaaaatttaaccgtagtggtgactccagatacacgaagtgcggtgcgtttatcacgtgttttatcggaattaagcagtcaaaatgtatgccttttccctgattgggaaaccttaccttacgatactttttctccccatcaagaaattatttcctctcgtttaagtgcgcttttccatttacaaaatgcgaaaaaaggcattttcttattgccgatttcgacattaatgcaacgcctttgcccgccacaatatttacaacacaatgtgcttctgattaaaaaaggcgatcgtttggtcatcgataaaatgtgcttacaattagaagcagcgggctatcgagctgtggagcaagtattagaacacggcgagtacgcagttcgtggttccttgttggatcttttcccaatgggaagtgcggtgccttttcgccttgatttttttgatgatgaaattgattctattcgcacttttgatgtggatacgcaacgcactcttgatgaaattaactcaattaatcttttgccagctcacgaatttccaacggacgacaaagggattgaatttttccgtgcgcaatttcgtgaaacttttggggagattcgccgagatcccgaacatatttatcagcaaatcagtaaaggtaccttgatttctggcattgaatattggcagccacttttctttgctgaaatggcaactttatttgattatttgccggagcaaacgctgtttgtagatatggaaaataatcaaacgcaaggcgagcgtttttatcaagatgccaaacagcgttatgaacaacgtaaagtggatccgatgcgtccgcttttatcgcctgaaaaattatggcttaatgtagatgaagtcaatcgccgattgaaatcttatccacgtattacatttaaagcggaaaaagtgcggtcatcggtacgccagaaaaatttacctgttgccgctctaccagaagtgactattcaatcccagcaaaaagaaccattgggacaattacgtcaatttattgagcattttaaaggaaatgtactgttttctgtggagacggaaggtcgccgagagactttgcttgatttgctttcaccgttaaaactcaagccaaaacaaattcaatctttagaacagattgaaaatgaaaaatttagcttgttagtcagctctcttgaacaaggttttataattgaacaatcgcttcctgttgcgattattggcgaagctaatttacttggcgagcgcattcaacaacgttctagagacaaacgtaaaacaattaatcctgatacgcttgtacgaaatcttgccgaactgaaaatagggcaaccagttgtgcatcttgatcacggtgtgggacgttatggcggtttggtcaccttagatacaggcggcattaaagccgaatatttgctactaaattatgcaaatgaatcgaaactttatgtgccagtgacttcattacatttgattagccgttatgttggtggctctgatgaaagtgcgccattacataaattagggaacgaggcttgggcgaaatcacgccaaaaagctgcggagaaaattcgtgatgtggcggcagagttattagatgtttacgcacaacgtgaagcgaagaaaggctttgcctttaaatatgatcgtgaagaatttcaacaattttccgcaacctttccttttgaagaaacctacgatcaggaaatggcaattaatgcggtaatttcggatatgtgtcagcctaaggcaatggatcgccttgtttgtggtgatgtgggttttggtaaaactgaagtggcaatgcgcgctgcctttttggctgtgatgaatcataagcaagtagcagtgctagtgccaaccacactgttagcccaacagcattatgagaattttaaagatcgttttgcgaatttgcctgtgaatgtcgaagtgttatcgcgtttcaaaactgcaaaagaacaaaaacaaattctggaaaaccttgcagaaggaaaagtcgatatattaattggtacccataaattaattcaatcagatgtaaaatttaacgatcttggattgttgattattgatgaagaacatcgttttggtgtagggcaaaaagagaaaatcaaacagcttcgtgcgaatatcgatattcttacgctaacggcaacgccaattcctcgaacgcttaatatggcgatgaatggcattcgtgatctttccattatttccacacctcctgctcgccgattaagtattaaaaccttcgtccgtcagaatggcgatcttgttgtacgagaagcgattttgcgtgaaattctccgaggtgggcaggtttattatctccacaatgatgtcgcaagcattgaaaatacagcagaaaaactgaccacgcttgtgccagaggcgcgagtaattgtggggcacggacaaatgagagaacgtgagttagaacgtgtgatgagtgatttttatcatcagcgttataacgtcttagtttgttcaaccattatcgaaacgggtattgatgtaccaacggcaaataccattattattgaacgagcggatcattttggtttggctcagttgcatcaattacgtggacgagtcgggcgttcacatcatcaggcttatgcttatttgcttacgcccccacctaaaatgatgacaaaagatgctgaacgccgtctagatgcgttggaaaatcttgataatcttggggctggttttatcttggcaacccacgatttagagattcgtggtgctggcgaattacttggaaacgaacaaagtggacaaattgaaagcatcggtttttcgctttatatggaattattggatgcagcggttaaagcgttaaaagaagggcgtgaaccatcattagaagaattgacgcaacaacaagcggatattgaattgcgtgtgcctgctttactgcctgatgattatctaggagacgtgaatatgcgtttatccttttataaacgcattgctgcagcagagagtaaagcagaattagatgaattaaaagttgagttgattgacagatttggattattgcctgatgcaacgaaaaatttattacaaattacagagttgcgtttattggttgagccgttgaacgttgtgcgaattgatgctggaacacaaggcggttttattgagttttcagcaaaagcacaagtgaatccagataaatttattcaattaattcaaaaagaacctattgtgtatcgatttgatggcccattaaaatttaagtttatgaaagatctatccgataacaaagtgcggttagaatttgtggtggatttgttaagaacgattgctgcataa

SEQ ID NO: 2462 - DNA, 174 bp, H. influenzae strain 86-028NP
atgacagaacaaaccgcaaaaccaaaaggctggtttaaacgcgcacttgaaaaatatgacaacttcattaaagaatggggtttagatcaaccgaattgtagctgcgtgcctatgtcagcaacagaagatgaaaatggtaatttgaagacaaaagaatcttctttaaagaaataa

SEQ ID NO: 2463 - DNA, 1971 bp, H. influenzae strain 86-028NP
atgtcatctcgccagcttcaaattttaatctgcaaaactttgccgcttgtgcctgataacgtattaattatcggcgaaagtggcattgctttttctaaagcaacgaatttgcttggacaagaatttgaacatatcttatttgatgcgcgaaatggcattcatcttgaagcgctggctattgcagctggaacactgaaaatgggcggcacactttgtttagtgttatctgattgggaaaatttatctcagcagcctgatcaagatagtttacgttggaatggaaatcagtcagcaatcgccacgcctaattttattgatcatttcaaacagtgcattgaacgttatcatttccccattttaagagaggaaagtgcggttgaatttcctacggttttttattctaacgaacatcacaaaaatgctacgttagcgcaacaacaaattatcgagactattttacaagccgagcaggatatttattttctaacctccaagcggggaagaggaaaatccgcattattgggtatgcttgctaaccaaattcaagcaccagtttatctcaccgcaccgaataaaagtgcggtgcattccgttattgaattttcagaacgagagatagaatttatcgcgcctgatgaactggctattcggttacaacatgaaccagaattcagtcaatcagcttggttgctggtagatgaagcggcggtaatcccattgccgttattgcaagaatattctcaatattttcaacatattgtcttcagcacaacaattcatagctatgaaggtacggggcgtggtttcgaattaaaatttaaacggaaaattcaccgcacttttcagcattttgagcttaaacagcccctacgttggcaagaaaatgacccgttagaacattttattgatgatcttttgttgctaaatgccgaagatgattttcagcactttgactataacaatattacttataacatagaggaaaacgctaaaaatctttccttcccctgcttgcgggggaaggtgcccgaagggcggaagggggatttagatatagccagcctccctcaagctttggaagctcccctcacaagtaagggtagtaaaggaaaatataatcgtcaatttttatttcgagatttttatggcttaacgacattggcgcattatcgaacatcgccactcgatcttcgccgtttacttgatggagaaaatcaacgtttttattttgccgaatatcaacagaatttgctcggtgcaatttgggcattagaagaaggaaatatggctgatgatgagttgattattcaaattcaacaaggcaaacgccgcccgaaagggaatcttgttccacaggcgttatgtttctatgaaaacttgcctcaagcctgtaaattacgatctttacgtatttctcgtatagcggttcagccaaattggcagcaaaagggcattgggcaaaatttgatgcaagccatggaaaatgccgatgtggattttctttcagtgagttttggctacaccgacgaactggcaaaattttggcaaaagtgcggttttgttttggtgcatttaggcgagcatcaagaagcgagtagtggttgttattcagcgattgcccttaaaggactttccaaagaaggcttggctttagttgatactgcgtacaaacaatttcagcgtaatctccctttatcttttcatccgtttgccataaattttgagcaaaatcagcttgattggcagcttgatgattttgattggatgagcttaaaaaacttcgctaattttcaccgcactttattttcgagcgttcctgcgatgaggcgtttattaaaattagcgggcaaagaaaatttcccattaatttccgcttatttaacaaaaaaacaacttcctattaacaagaaaaaaggcgtagaatgtttgcgtttagaaattaaacaatatttagagcgaggaactttatga

SEQ ID NO: 2464 - DNA, 342 bp, H. influenzae strain 86-028NP
atgttagttgatttacatatttttttcgcctttttaagtttggcattgttagtaattcgtggtgcaatgcagcttaatggtaaaaattggcgttcgataaaattattaaaaattttaccgcacttatcagataccttgctgattgtgtctggcgtcgtcattttatacctctttgcttttggtattgaatggtggttagtggctaaattcgcattactgattttgtatattgtgtttgctgcaaaatttttcagtaaaaaagtttctcaacccaaaagcattttcttttggcttgcttgcgtaagttttattggtgcgatgttaattgcctatttaaaataa

SEQ ID NO: 2465 - DNA, 1671 bp, H. influenzae strain 86-028NP
atgtcatctcaatttgtgtatacgatgcatcgtgtcggcaaagtagtgccgccgaagcgtcatattttgaaagatatttctttaagctttttccctggtgctaagatcggggttttaggtttaaatggtgcgggtaaatcgactcttttacgcattatggcaggcgtagataaagagtttgaaggggaagctcgtccacaaccgggtattaaaattgggtatcttccgcaagagccaaaactcgagccacaacaaaccgtgcgtgaagcagtggaagaagcggtttctgaagtgaaaaatgcactgactcgtttagatgaagtgtatgcgctttatgcggatcctgatgcagattttgataaattagcggcagaacaagccaatcttgaagctatcattcaagcgcatgatgggcataatttagataaccaattagagcgtgcggcagatgcgttacgtttacctgattgggatgccaaaattgaacatttatctggtggtgagcgtcgccgagtggcactttgccgcttattactcgaaaaaccagatatgttgttgttagatgaaccaactaaccacttagatgcggaatctgtggcgtggttagagcgattcttacacgactacgagggtacagtggtagcaatcactcacgaccgttatttcttagataatgtggctggttggatcttagagcttgaccgtggcgagggcattccttgggaaggcaactattcttcttggttagagcaaaaagagaaacgtttagaacaagaacaagcaactgaaaacgcacgtcaaaaatccattgcgaaagagttagaatgggttcgtcaaaatccaaaaggtcgccaagcgaaaagcaaagcacgtatggctcgttttgatgaattgaactctggcgaatatcaaaaacgaaacgagacgaacgaactctttattccacctggcccacgcttaggcgataaagtgattgaagtgcaaaacttaaccaagtcttatggcgaccgcactttaattgatgatttatcattcagtattccaaaaggggcaattgttgggattatcggagcgaacggtgcaggtaaatcaaccttattccgtatgttgtcaggtcaagaacaaccagattcaggttctgtgacaatgggcgaaaccgttgtgcttgcttcggtagatcagttccgtgactcaatggatgacaagaaaactgtgtgggaagaagtgtctaatggacaagacattcttactatcggcaactttgaaattccaagccgtgcttatgtggggcgtttcaacttcaaaggtgtagatcaacaaaaacgtgtgggggaattatcgggcggtgaacgtggtcgtttacacttagcgaaacttctacaacgtggtggtaacgtgctattactggacgaaccaaccaatgacttagatgttgaaaccttgcgtgccttagaaaatgcgatcttagaattcccaggctgtgcaatggttatttcgcacgaccgttggttcttagaccgtatcgcaacgcatattttagactacggcgatgaaggtaaagtcacgttctatgaaggtaacttctcagactacgaagagtggaaaaagaaaaccttaggcgatgcagccactcagccacatcgtattaaatataaacgtattgcgaagtaa

SEQ ID NO: 2466 - DNA, 324 bp, H. influenzae strain 86-028NP
atgatgacgagaaaacccacctctgttggtgaaattctacaagaagagtttttagaacctttaagtcttaaaattagtgatttagctcaaattttagatgtacatcgtaatacggcaagcaatattgttaataatagttcacgaattacgctagaaatggcagttaaacttgctaaagtatttgatactacgcctgagttttggcttaatctgcaaacacgtattgatttatgggaccttgaacacaataaacgttttcaacaaagtcttgcaaatgttaagcccgctctacatcggcatgatacttctacatttgcaatgtaa

SEQ ID NO: 2467 - DNA, 306 bp, H. influenzae strain 86-028NP
atgtttaatttaaagcgtgagcattttagagatgattatctttataggttttatcaatatggtgatactcatagtaagattccttctaatttgtataaagtattggcaagaaaattagatatgataagtgcctcagaaaatatcaacgatttacgttctccaccagctaaccatttggagttgcttgagccaaaagaaaataaaatttattctattcgagtgaataaacaatatcgtttaatttttaaatatgaaaataacgaagtaaataatttatatttagatccacattcttataatttgtaa

SEQ ID NO: 2468 - DNA, 621 bp, H. influenzae strain 86-028NP
gtgaaaacgtattcattattactcggtttattcattagttttggtgttttagcccatcctcacgcatttattgatatacaaaccacgcccattatagaaaataatcaactcacaggtttttcaatgaaatggacgttggatgaaccaagttcgtctgcagttatttatgatatgaaacaagctagaactaaagcggaaaaacaaaaacttcttgatgatgtaatgggaaatatcgtcagtgagcattatttcagctatctatatgatgcccagaataataaaatcaaatattcccctcgcccaaaaaattacggcattaatgttcaaggcttacaactgcaatattattttgatgtgccactcgcccatccgcaaaagttagaaaaaaacacatttagcttacaaacttacgatcccacttattatgtggcgatgacttacgcttcaaaaagtgcggtagatttttccgcactttcgaaaaattgccaaggaaaattaattgaacctaatgtggatgaaaaaatccaagcctacgcatcttcacttgataaatcccaaaagaacgaagatgattccttaggcgtaatgttcgcgcaaaaaataataattcaatgtgagtag

SEQ ID NO: 2469 - DNA, 969 bp, H. influenzae strain 86-028NP
atgaaaaaatataaaactgggctcgtgttattagtgattgcactcgccttacttgtctatttttccccttggtttttcttacatattgccagttggcaaaaagagtttaatcagcttatttcggaaaatttacatcaaattcaaaataatagcatcaaggcaggcatcacacttattttcgtcagctttatttatggcgtactccatgccctcgggccaggacacggcaaatttattattgccagctatctttccacgcatgaaagccaattaaaacaaagcactatcttgagcttactttcatccttaatgcaaggcattgtcgcgattacagcaacaacattgcttgttgtagtgctaaatctttcatcacgttatttcaaattaagccagctttggttagaacgaactgccttgctattattggtatttctcggctgttattggatttggcaaggtctacgtgcctatcgtaaaaaagctaaattaaccattaaatccctcaatcccctccctctacacgaaaaaagtgcggtgaaaaataaccgcacttttcagccaaacacttgtagctgtggacaccaacatttgccaagccccacgcaaactgcacaagcaaccaatctaaaatcacaattcctcgtgattctaacaattggcatgcgcccatgtagcggtgcaattttcgttttatttttagcttatatgcttgatctttatagctggggaattttagctgtattagccatgtctttcggcacggggcttatgctgtcagccttcgcaggaattgtacgttatgcacgaaataccgcaatccacttagggcattggtatagttcaaaaaatacgaaaggaaaaagcgaaagcatcgtgaaactaatcgctggtggaataatgctattttttgccttgagcttgttatacggcacaaccatctcaactggcggaagcaaaatcctattttga

SEQ ID NO: 2470 - DNA, 2040 bp, H. influenzae strain 86-028NP
atgtctgaaaaaatcaacacaaaaccgttcattctacattccgactttcgtccctctggcgatcagccacaagctatcgaaaaattggctgaaaatttaacggatggtttggcgcatcaaactttgctcggggtaacaggctcggggaagacgtttactatcgccaatgtaatcgctcaattaaatcgacccgcaatgttacttgcgccaaataaaacccttgctgctcagctttatgcagaaatgaaagctttttttccagaaaatgcggtggaatattttgtgtcttactatgattattatcagcctgaagcctatgtgcccagcagtgatacatttattgaaaaagatgcgtctattaatgatcaaatcgaacaaatgcgtctttctgcgacgaaatcttttctagaacgtcgagataccatcgtggtggcttccgtttctgcaatttatggtttgggcgatcctgatagctatttacaaatgatgttgcatttacaacaaggtgccattatcgatcaacgccaaattttagcgaagttagcggaattgcaatatacccgaaatgatcaagcatttcagcgtggaactttccgtgttcgcggagaaattattgatatttttcctgctgaatccgatgatcgtgcggtgcgtattgaattatttgatgatgaaatcgagcgtttaagtttatttgatccgctcactggcagtagttttggtgctgtcccacgttttacgatctatcctaaaactcactatgttacgccaagagaacgtattttagatgcgatagaaaacatcaaaaaagaactggtatcacgccgtgaatacttcattaaagaacataaacttttagaagaacaacgtatcagccagcgtacccaatttgatattgaaatgatgaatgaattgggctattgctcgggaattgaaaactactctcgctatttatcgggaagaaatgagggcgaacctccaccaacattatttgattatatgccctctgatgccattttaattattgatgaatctcatgtaactgtgcctcaaattggtggaatgtatcgtggcgaccgttcacgtaaagaaaccttagtcgaatatggtttccgtttgccatccgccttggataatcgtccgttacgctttgaggaatttgaacgcttagctccgcaaaccatttatgtttccgcaacaccagggccttatgaattagaaaaatcaggcactgaaatcatcgatcaagtggttcgccccactggtttacttgatccactcattgaaattcgtccagtgtcaattcaagtggatgatttactttccgaagctcgccaaagagcggataaaaatgagcgagttttagtcacaacactcactaaaaaaatggcggaagatttaacggattatttggatgaacacgggattcgtgtgcgttatctgcattccgatattgatactgtggagcgagtagaaattatccgtgatttgcgtttaggggaatttgatgtattggttggaattaacttattgcgtgaaggtttagatattcctgaagtgtctcttgtggcgattttagatgcggacaaagaaggatttttacgttctgaacgctctttgatccaaaccatcggtcgtgctgcgcgaaacttaaatggtaaagcaattttatatgcagatagcatcacaaaatccatggaaaaagccatcaccgaaactaatcgtcgtcgtgaaaaacaaataaaatacaatgaagaacatggcattgtgccacaagcattgaataagaaagtcggtgaattattagatattgggcaaggtgcaaaccaaaaagcgaaagccaataaacaacgtggaaaaatggcggcagaaccaaccgcactttataatgcaccgaaaaatgccaaagaatatcaacaacaaatcaaaaaattggaacaacaaatgtataaatttgcgcaagatttggaatttgaaaaagccgcagcaattcgcgatcaattacatcaattacgtgaacaatttgtttttgataactaa

SEQ ID NO: 2471 - DNA, 1926 bp, H. influenzae strain 86-028NP
atgaaaaaagcacattttcctttattccccatcttcacattcgtgttgattaatctcatcatcctttccttatcccgtttgggacttgctgtgtggcaatcagagcgtgtatccgccgtagatggctggttgcaattatttttgcaaggcgtacgaatggatgttgtggcactttgttatttatttggcgtaccagcattgctcacaacattgttccatagcagtaaagtttgggtaaaaattttacgcctttggctaacccttggtagtgtgtttattatctttatggaaattgccacacctgcctttattgaaacctacgattaccgcccaaatcgtttatttatcgaatacttgatttatccgaaagaagttttttcaatgcttgcggaaggacatttaagtgcggtaatttttagccttgttttcacgattttagctgccgtgatttattggaaaatttctggttgggcagtcaaaaatttaggttcaatcagttggaaacttcgccctgtgattgctttgcttgtgattgtcttgagcttccttggggcacgttcaagttttcaacaccgtggtataaatcccgctatggtggcattttcttctgatgcgttagtgaattctctggtgcttaattctggctattccgtgatttatgcggcacagcaatttaaagatgaagaaaaatcttcagaaatgtacggaaaaatggatgcagatgaaatttttcgtattgttaaagccagtcgtggccgtccagaaagtgattacatttcagataaatacccaactttaacgaaaaatgtcgcgacttatcagggtaaacctaaaaatatcgtgattttgctacaagaaagtctcggtgctcagtttattggaacacttggtggcaaaccactttctccaaatgtggatcagctcgcaaaagaagggtggttatttgaaaatctttatgcaacaggcacacgttcagtacgtggtattgaagcaacaacggcaggttttacgccaacaccagctcgtgcagtggtgaaacttaataatgcccaaagtggtttctttactattgcggatttattacataaacaaggctataacacttcgtttatttatggtggcgaaaagcacttcgacaatatggcgagttttttctacggtaatggctttaaagatatttgggatcaacaagactatcagaatccaaaatttactggcacttggggcgtgagtgatgaggatttatttgataaagccaatgaaactttcacgaaattacaaaatgaaggtaaaccgttttttagtttagtgtttagttccagcaatcacgatccatttgaatatccagatggcaagattgagctttatgagcaaccaaaagccactcgtaataacgcagcaaaatatgcggattatgccttaggtcatttctttaaaatggcaaaacagtctaattattggaaagatacgattttcttaattgttgcggatcacgattctcgtgtaggcggagcaagtcttgtgccgattaagcatttccatattccagccttgattcttggtgatggcattacgccacgccgtgatagccgtcttgtgagccaaattgatatgccaactacattgctttctttagctggcgtaagtggcaattatccaatgattggttttgatttaacgcaagatgtaaacccagatcgtgcttttatgcaatacgatcaaactcaagcaatgatgaaaggcaataatgatgtggtaattcaaatgtcaaataaagcagcgcaaggttatcattatgataaatcaacagaaactttaacgccaaaagacgtacctgatgcaatgaaaaaagaggcattggctcacgctttattaggtagttatttatataaaaatcgcttgtattcttcaggtgaaaataaataa

SEQ ID NO: 2472 - DNA, 2271 bp, H. influenzae strain 86-028NP
atgagcgaacaattacgtcaagcagccttagatttccacgaatttccaattcctggaaaaatcgaagttaccccaacaaaatcactcgcaacacaacgcgatctggctttagcttattcaccgggtgtggcagagccttgtttagaaattgaaaaagatcctgccgcctcttacaaatataccgcgcgtggcaatttagtagcggtgatttccaatggtacagcggtgcttggacttggcaatattggcgcgctagcgggcaaacctgtaatggaaggaaagggcgtattgttcaaaaaatttgcaggcatcaacgtgtttgatattgaagtgaatgagcatgatcccgataaacttgtggatattattgcctcgttagagccaactttcggtggagtaaatcttgaagatattaaagcaccagaatgtttttatattgaacaaaaattacgtgagcgtatgaatattcctgtattccatgatgaccaacatggaacagcgatcatcagtgctgccgcgatcatcaattctcttcgtattgtaggtaaaaaaattgaagatgttcgacttgttgcttctggtgcgggtgcagcatcaattgcgtgcttgaacttattgctttctttaggtatgaaacgtgaaaatatcacggtttgcgactcgaaaggcgtagtatataaaggtcgtgatgacaaaatggatcaaaccaaaaaagattatgcaattgaagataatggctggcgtaaacttggtgatgcgatgccaaatgcagatattttcttaggttgttctgcggctggtgcgcttacacaagatatggtgaaaaccatggctgcgcatccaattattcttgctttagctaatccaaatcctgaaattaccccgccagaagcaaaagcggttcgtcctgatgcgattgtatgtacaggtcgttctgattatccaaaccaagtaaataacgtgctttgtttcccatttattttccgtggtgcattagatgtgggcgcaaccactattaatgaagaaatgaaacgtgcggcagtttatgccattgctgatcttgcattagaagagcaaaacgaagtggtaacctctgcttacggtggagaaggggcaacatttggtgcggattatgtgattcctcgtccatttgatcctcgcttgattgtgcgtattgctccagcggtagcaaaagctgcaatggaatctggtgtggcaactcgtccgattcaaaattgggatatttatattgaccaactcactcagtttgtttacaaaaccaacttgtttatgcgccctattttcagccaagcaaaatcggcaaaacaacgcattattttagcggaaggggaagaaaataaagcattacacgctacccaagaagtgatttcaatgggcttggcaaatccaattttaattggtcgccgcagtgtgattgaagaaaaaattaaaaaacttggtttacgtttaactgcaggtgtggattttgaaattgtggataacgaagataatcctcgctatgaagaatgttggaaacactattacgaacttactaaacgtaaaggcattacacctgcgattgcaaaacgtgtcgtgcgttctaacactaccgtattagcttctacattgcttagcttaggttatgcagacgctttagtatgtggtttatttggttcatacggaaaacaccttgcatctattcgcgatattattggcttaaaagacggcgtgaaaactgccgctgctttaaatagtcttgtattaccgacgggtaacgtattcttaacagatactcacgtaaacagtaatcctacagcagaagaattagctgaaattaccttaatggcagcagaagaaattcatcgttttggtattgaacctgcagttgcattgctttctcattctaattttggttcgtctgattcattaggcgcaccaaaaatgcgcgaagtattacaaatcgtcaaagagcgcaatccacatttaatgattgatggggaaatgcgtggcgatttagcgatgaatgaagctcaccgaaaagaagtcatgcctgatagcccattgaaaggaagcgcaaatttattagtgttccctgatttgagtgcatcacgtattagttatagcttattacgcagcaccactacggcaattaccgttggcccgatcttaatgggtatgaataaatctgcgcatattcttaatccaggtgcatctgttcgtcgtattatcaatatgattgcctatgcagcagtgaaagcacaacaagagtaa

SEQ ID NO: 2473 - DNA, 621 bp, H. influenzae strain 86-028NP
atgaatccatttcaaaaaattaaaagtgcggtgaataaatgccaaagattttttatcaatcgttcattacaacgtaaattgactaaccaaggcatgactgtcatttctgccaattgcgtgggggcttttatcttacatgatttacaccagccgtttaattccccttttgtgaatctctgtctctcgccacaggattttttgcgttatttacaaaatatggatttctaccgtactcaacctctcacattcgtacaaacagaaaaaagttatcctgtgggaaaacttgctgatcttgaaattcattttatgcattatcacagtgagcaagaagccaatgaaaaatggcaacttcgcacgtcacgaatgaagttagacaatctttttattatgatgacagatcgagacggcgtgaccgaaaaagacattcaactttttgatcaactccctttcaaaaataaagtgatttttactcacaagccctatccagcttttaaatcggcttattatataaaaggcttcgagaagcaaaatcaggtgggcgatatttttgaattttctggctggaatgggaaaaaatattacgatcaattcgattacctgaagtggtttaaccaagcttaa

SEQ ID NO: 2474 - DNA, 699 bp, H. influenzae strain 86-028NP
atgagattagataaatttattgctgaaaatgtgggattaactcgttctcaagcaacaaaagcgatccgccaaagtgcggtaaaaattaatggtgaaattgtcaaaagtggtgcggttcaaatttcacaagaagataaaatctattttgaagatgaattattaacttgggtagaagaaggccagtattttatgttgcataagccacaaggctgtgtttgttctaatgatgacggcgactatccaacaatttatcaattttttgattaccctttagctggaaaattacatagcgcaggtcgcttagatgtggatacgacaggtttcgtattgcttaccgatgatggacaatggtcacatcgcatcacttcgccaaaacatcattgtgaaaaaacctatttggtaacattagctgatcccgtagaagaaaattatgcagcggcttgttcggaaggtattttattacgcagagaaaaagagcccactaaaccagcaaaattagaaattttagatgattacaatgtgaatctgaccatttctgaaggtcgttatcatcaagtaaaacgtatgtttgccgcacttgggaataaagtcgttggattacatcgctggaaaattggtgatgtagtgttggatgaatccttagaagaaggcgaataccgcccattaactcaaagtgaaattgaaaagttagtaaaataa

SEQ ID NO: 2475 - DNA, 1197 bp, H. influenzae strain 86-028NP
atgaatcaacaaaaatcgactttcatctttattcttaccctcggtattctctctatgctaccgccctttggcgtggatatgtatttgccgtcttttttagaaattgcgaaagatctcggcgtgagtccagaacaagtacaacacacgctcacctcttttgcttatggcatggcgtttggtcagcttttttgggggccttttggtgatagtttcggacgaaaaccgatcattttactcggtgttattgtgggtgcattaacagctttagtgcttaccgaaataaattcagttggaaattttaccgcacttcgttttgtgcaaggtttctttggtgccgcacctgtagtactttctggcgcattattgcgtgatttatttagtaaagatcagctatccaaagtgatgtccaccattacgttagtgtttatgcttgcgcctttagttgcgccaattattgggggttacatcgttaaatttttccattggcatgcgattttttacgttatttcgcttgtgggattattagccgctgcattggtctttttcatcattccagaaacccataaaaaagaaaatcgcattccgctgcgcttaaatattatcgctcgcaatttccttctgctttggaagcaaaaagaagtgcttggctatatgtttgccgcctcttttagctttggcgggttgtttgcttttgtgacggcaggatcaattgtctatatcggcatttatggcgttcccgtcgatcagttcggttatttctttatgatgaatatcgttacgatgatctttgcctcgtttttaaatagccgatttgttactaaagtgggtgcagaaacaatgttacggatagccctcgcaattcaattcctttctggaatgtggctaattttgaccgcacttttagatcttggtttttggccaatggcaattggcgtcgcctttttcgtcggtccaaacccagtgatttcatcaaatgcaatggcatcagctttagaaaaatgtcctcaaatggcgggaacaacaaattctttgattggtagcgtacgttttgcagtgggtgcaattatgggaagtttagtcgcgtcaatgaaaatggatactgccgcaccaatgctctttactatgggggcatgtgtcgtgatttccgtgttggcgtattactttctaaccagccgaaatcttaaaagccgtgggtaa

SEQ ID NO: 2476 - DNA, 801 bp, H. influenzae strain 86-028NP
atgtcagaacaatcttctaaatatatcgcagcattgcttgcggtattatcgatctcaatggtgcttggcatcgatctatttattttttctttgcaatctgaaaagcaaacaatgcctcatttaggtgtaggcgtgttggttgcacagttaatttcgttgttggtgttttatcgcggcgaaatttgcccaggacaacgtggtcgtttaatcaaagtgaatatgacttttgctatttattgggcagtgtggttgctgataagcctattacaaaataatcacacgcttactaacgtaatgagcgtatgtggtctttctgtcgtgtattttatttggaaacaacccaaaactgaaaaaattcgtaacagctttttattgatggctgcattaattgcgggtttaggttgcttgagttatttaatgatttttaccgtgcttcctgcgagtgattttgctgaatataacccttttgcaccaattttatctggcgtgattttagcaaatcttgcgcttgttattgcacgaaatcgtttacaaggttttatagcattgttgcccttagcaatgattatattgcttgctctaaatgctttggcaatgtttttatttttacttttaaatggtatggaaagtgcggttaattctgacagtgtttttgcctacatcatttattttgtttgccattttgtgattgcggctattctgattctgcatagtttccaaaagtggatattatctaccaatagtttatttatcctattatttattgctgtttgcttgccgttatggatggtttttgtttaa

SEQ ID NO: 2477 - DNA, 663 bp, H. influenzae strain 86-028NP
atgttacttagtattttatatatcatcggtatcaccgctgaaggaatgacaggcgcacttgcggcaggtcgtgagaaaatggatatttttggcgtgatcattatcgcatctgtgactgccattggtggcggctctgtgcgtgatgtactgctcggacattaccctctcggctgggttaagcacccagaatattttttaatggtggcaagtgcggcggtaattaccgtatatgttgcaccatttatcaatcattttatgcgctactttcgcactattttcttggtgcttgatgcgatgggcttagtggtgtattccattattggcgcacaaattgcaatggatatgggacatagccttaccattgtttgtattgcaggctgtattactggtgcctttggcggggttctacgcgatatgctatgcaatcgaattcctctcgtgttccaaaaagaactctatgccagcattgcgctatttgccacgctgacttattacgcattaagtacacttcaagtagaacatacacttgccgtgttactcacacttattagcagctttactttacgccttttagctattcatttcgaatgggggttgccggtgtttaattaccaagaactcacatcggaagaacaagataagctgccaaataaaaagaaataa

SEQ ID NO: 2478 - DNA, 1254 bp, H. influenzae strain 86-028NP
atgttagaacaaatgggtaaacaagccaaagatgctgcatttatcttggctcaactcaccactgctgaaaaaaattgtgcattatccattattgcagaacaactccaacaacaagcaccgcttatcttagccgaaaacgcaaaagatattgaacttgctaaacaaaatggattatcggatgccttgattgatcgcttactgctcacacaagaacgtttacaaagcattgctaatgatgtacgccacgttatttctctagcagatcccgtggggaaaatcatagacggcggtacattggatagcggacttaaaattgaacgcgtacgcactccgctcggcgtcattggtacaatttatgaagctcgcccaaatgtgaccattgatgtggcaagtctttgccttaaaactggcaatgcggtgattttacgcggcggtaaagaaacacaattttctaacaagattttaatcgaagttgtacaaaatgctttagagcaagcaggcttaccaaaatttgcggtgcaagccattaccgatccaaaccgtgaactcgttatgcaattattaaaactggatcgctatgtggatatgattattcctcgtggtggttcgggtttacatgaattgtgtaaacaacattcgactattcctgttattgtgggtggtgtgggtgtttgtcatactttcgttgaaaaaagtgcggatcaaaataaagcgatttttgttattgataacgccaaaacccaacgtccaagcacctgtaacacattggaaacattgttagttcaacattctattgctgaagaatttttaccaaaactcgtctctcacctcgctaccaaaaacgtaaaatatcacgcaaaatccaccgcacttaatatattgaaacaagcaggtgcgaatgtctgcgaagtgacagaaaaagaattgcgaaaagaatggggatcattggatttgaatgtggttgttgtggaagatattcatgccgctattgagcatattcgccaatatggtacgcaacattctgaaagtattttaacttcctcacaaaacctagcacgtcaatttatcaatcaagttgatgcggcagccgtttatgtgaatgcaagtacacgctttactgatggcggacaatttggattaggcgcagaagttgccgtgagtacccaaaaacttcatgctcgtggccctatggggttagaagcattaacaagttataaatgggtttgtgaaggcgaatacaccgttcgcaaataa

SEQ ID NO: 2479 - DNA, 1146 bp, H. influenzae strain 86-028NP
atggcaaaaaaagattactacgaagtccttggcctacaaaaaggggcgagtgaggacgacatcaaacgtgcgtataaacgtttagcgtctaaacatcatcccgataaaaaccaaggcagtaaagaagcagaagaaaaattcaaagaaattaatgaagcttatgaagtattaggcgacgatcaaaaacgcgcagcctacgatcaatatggccacgcagcctttgaacaaggtggtggcactggtggcttcggtggcggctttggcggtgctgattttggtgatatgttcggtgatatttttggcgatattttcggtggtggacgtggtcgtcagcgcgttgttcgtggcgaagacttacgttatgacttagaaattagcctagaagaagccgtaaaaggtacaaccaaagatattcaaatcaatactcttgcacattgtgatagctgtggtggctctggggctgaaaaaggttctaaagtggaaacttgtccgcattgccacggttctggtcgaattcgtcgtcagcaaggtttcttcgtatctgaaagtatttgtccaacttgtcacggtagcggtaagaaaattgaaaaaccttgtcgcagttgtcatggagaaggacgagttcataagaaagaaaatctttcagtaaaaattcctgcaggcgtagatacgggcaaccaacttcgcttagctggtaaaggtgcagcaggcgaaaatggcgcaccagctggagatttatatgttgtgattcacgtgagagaacataatatttttgaacgtgatggctctaatctttactgtgaagtaccgattagctttgctactgcagcccttggcggtgaaattgaagtgccgaccttagatggcagagtgaaacttaaaatccctgctgaaacgcaaacaggaaaattattccgcatgcgaggaaaaggtgttgcttctacacgtagtggttatgcgggcgatttaatttgccgtatcgtggtagaaacgcccgttaatttaaccagcgaacaaaaagaattactccacaaacttgaggaaagtttacaaggtaaagatttaagtaaacacgcaccaaaatcttcaggatttttagacggtgtgaaaaaattctttgataacttgggtaaatctgacaaataa

SEQ ID NO: 2480 - DNA, 1908 bp, H. influenzae strain 86-028NP
atgggaaaaattattggtattgacttaggtacaacaaactcttgtgtagctgtaatggacggcgataaagcgcgcgtaattgaaaatgcagaaggggcacgtactactccgtcaatcattgcatatacagataatgaaaccttagttggtcagccagcaaaacgtcaagcaatcactaacccaaaaaatacattgtttgcgattaaacgtttaattggtcgtcgttttgaaagtgaagaagttcaacgcgatattaaaattatgcctttcgaaattactcgtgccgacaatggcgatgcttgggtaaacgtgaaaggtgataaattagccccaccgcaaatttcagcagaagtgttgaaaaaaatgaaaaaaactgcagaagatttcttgggtgaatctgtaactgaagcagtaattactgtgcctgcatacttcaacgacgcacaacgtcaagcaacgattgatgcaggtaaaatcgcaggtttagatgttaaacgtatcattaatgaaccaacagcggctgcgttagcgtttggtttaggttcaagcaaagagaaccaagtgatcgctgtttatgacttaggtggtggtacatttgatatttcaatcatcgaaattgataactttgatggcgaacaaactttcgaagtattggcaaccggtggtaacactcacttaggtggtgaagactttgataaccgtgtaattgattacattattgatgagttcaaaaaagaacaaaatatcgatttacgtaatgatgcaatggcattacaacgtgtgaaagaagctgcagagaaagcaaaaattgaactttcatcagctcaatctactgaagtgaaccttccgtacatcactgcagatgcgacaggtcctaaacacttagcattaaatatcactcgtgcaaaattagaagcattagtagaagatttagtggcaagctcaattgagtctttgaaagcggtattaaaagatgcagataaaggtgtaagcgaaatccacgatattattcttgtgggtggccaaactcgtatgccacttgtacaacaaaaagttgctgagttctttggtaaagaagcgcgtaaagatgtaaaccctgatgaagcggtggcaatcggtgcggcagttcaaggtggtgtattaaaaggtgatgtgaaagatgttcttttattagacgtaactccattatctttaggtatcgaaaccatgggcggtgtgatgaccactttaattgagaaaaataccactattccaactaaaaaatcgcaagtattctcaacagcagaagataaccaaagtgcggtaactattcacgttcttcaaggtgaacgtaaacgtgcggcagacaataaatctttaggtcaattcaatctagaaggtattaatcctgcaccgcgtggtatgccacaaattgaagtaacatttgatatcgatgcaaacggcgtaatcaacgtatcagcaaaagataaaaatacgggtaaagagcaacaaattcgtattcaagcatcatctggtttatctgatgaagaaattcaacaaatggtgcgtgatgcagaagcaaatgctgatgcagaccgtaaatttgaagaagttgttcaagctcgtaaccaagcagatggtattgctcacgcaacacgtaaacaaattgcagaagctggcgatgcattgagtgtcgcagacaaagagaaaattgaagctgcagtcgctgagcttgaaacagcagcaaaaggcgaagataaagcagaaattgaagcaaaaattgaagcggtaattaaagcctctgaaccattaatgcaagcagtgcaagcaaaagctcaacaagctggtggcgagcaaccacaacaatcatcagcaaaagatgatggcgtggtagatgctgaatttgaagaagtgaaagataataaataa

SEQ ID NO: 2481 - DNA, 1443 bp, H. influenzae strain 86-028NP
atgaaaaaatcaaaaattgctgcaggcgtagtcatttctcttgctgccgtttggtgtgcaggtgcatggtttacagggaaaaaagctgaagaagaatatttacatcaactaaaacagttaaatcaactatttaccaaaactgaggcattagaagaaagtaaaattttttataaaaatataaaatttgaaagaggattatttgcctctcacattcaagatcaaatagaaattcacaaggcaaatgaaacgatcattattcctttatcatcaacactttatcacgggcctttgccgcttgatcgtgtggcaaaactgaatttcgttccagccattttttcaagccaaacattgttaggaaaaaatgcaacaactcaggcattctttgatatcacagaatcagagaaaccgttacaactgaatttcgcaatgaattattcattaagcggtaatgcggaattaaaacttgcatcggggcaatatcacaatgagcaatctaagacagattttgattggtcaaatgtcgtattaaatattgatttaaaccaaaatacaccaaataactatgtgctatctgtcgatacatttaattcaaatgcccctaatcatgcagtttcaaccgcttcatcaattaaaataaaagatcttgtcgtacaaggctcgttgcaaagcacaaaatggccatttatttatagtgggaatatcaatagtaaaataggctattttgagcaaaataccgaatctccagagactggcgaaaaattctctcttattcagaaaaatagccaagcaaatttaactacacaagttgagggtgatacagtaaatatcatcaataaaacgaatctggatgaattacatattaacggtaacaacttaggtaaagtgaccaacaatgtagaattcaaccatattgatggcaacgcattacaagaacttttaaatattttagttgcaataggcaaagccgactcagatatgcctttatctaaaacattggtgcaaaaattacaacaagcaggcatgatcattgcgaataatcagcctcaaattaaatttacccctctttctatttctgatgaaaaaggcaaagtggcattggatctaaatattgctttagtgccaaatcctaaatttgatttaatgcgcagtggcttatacaaacaattcaaagatttttcaatcaattttgatgtgaacaaagaaactgcgatttcattgttatctaaatttgtaccagaaaaccaaaagcaagatttcgttcaccgattgaatgaattagttaccgaaggtgaagtgaatgacattatcgtaaacacggacaaaaccgtaacattaacgcttgctctagaaaataacgacttgaaactaaacggcaagccaatcccagaagaacagttgaaagtggtactctttatacttgtaatggggggatttgggagataa

SEQ ID NO: 2482 - DNA, 459 bp, H. influenzae strain 86-028NP
atgcagacaacaactcgaaccctcactcaacacaaacgtattgcacttgtggctcacgatagttgtaaaaaaaatttactgaattggacgcaaaaacacaaagaggcacttaagcctcatatactttatgcaacaggtacaacagggcatattttagaacgagaaacaggtttaagcattcaatctttattaagtggtccgatgggaggtgaccaacaacttggtggattaatcgcagaaaagaaaatcgacatgatgatcttcttttgggatccaatgaatgctgcaccacatgatcctgatgtgaaagcccttatgcgtattgcaacagtgtggaatatccctgttgcgattaatcaaagctctgcagattttcttttaacttcagttttatttgaacaagatgtggaaattgacgtaccagattatgaagggtatttaaaagagcggttagcttaa

SEQ ID NO: 2483 - DNA, 2661 bp, H. influenzae strain 86-028NP
atgtctgagattttaaaaaatgacattgatccaatcgaaacacaagattggttgcaatcattagattcattaattcgtgaagagggcgttgagcgtgctcaatatattgttgagcaagttattggtcaagcacgtacaagtggtgtttcattgccaacaggagttaccactgattacgtgaatactattcctgtggctgagcaacctgcttatccaggtgatcacgccatcgaacgtcgtattcgttcagcagtacgttggaatgcgatcgcgatggttttacgcagtcagaagaaagatcttgatttaggtgggcatatttccactttccaatctgcagcaacaatgtatgaagtttgctacaaccacttttttaaagctgcaacagagaaaaatggcggcgatttaattttcttccaaggccatgcagcaccaggtatgtatgcgcgtgctttcttagaaggtcgtttaactgaagaacaaatggataacttccgtcaagaagcctttaccgacggtttatcttcatatccacaccctaaattaatgcctgaattctggcaattctctacggtttctatgggtttaggccctgtgaatgccatctaccaagcgcgtttcttaaaatatctcgataaccgtggtttaaaagataccaaagatcaaaaagtttatgcattcttaggcgatggcgagatggatgaaattgagtctaaaggtgcattaacttttgcggctcgtgagaagttagataacttaatcttcactatcagctgtaacttacaacgtttagatggccctgtgaatggtaatggtaaaatcgttcaagaattagaagggctatttactggtgctggctgggaagtgattaaagttttatggggcagcgattgggataaattattcgcgaaagatacttcaggtaaattaactcagttaatgatggaagtcgttgatggagactatttaacctttaaatctaaagatggtgcatatattcgcgaacacttcttcggtcgttatccagaaactgctgcattagttgctgatatgaccgatgatgaaatctgggcattacgccgtggtgcacatgatagcgaaaaattatatgcagcctatgcaaaagcacaaaatgcaacgaaaccagttgtgattttagcgcatcaagttaaaggttataaaattcctgaagcggaaagtaaaaataccgctcaccaatctaaaaaaatgtcttacgaaagccttaaaggtttccgtgacttctttgaattaccattaaccgatgaacaagtagaaaaattagaatacattaaatttgctgaaggcacacctgagtatgaatacttacatggtcaccgtaaagcattaaacggttatgttcccgctcgtcgtactaaatttgatgttgaatataaagttcctgcattagaagagtttaaagcattattagaagaacaacctcgtggtatttcaaccactatggcgtttactcgtgcattaaacatcttattaaaagataaaaacatcggtaaaactatcgttccaatgattgcggatgaagcacgtactttcggtatggaaggtttattccgtcaagttggtatttataacccacatggtcaaaactatgtaccttcagaccgtgatttagtggcttactatcgtgaagcaaaagatggtcaagtattacaagaaggtatcaatgaattaggtgcaaccgcatcttggttagcagcagcgaactcgtactctgtcaataaccaaccgatgattccattctttatctattactcaatgttcggtttccaacgtgtgggcgatatgatgtgggctgcaggcgaccaattagctcgtggctttatggtagggggtacttctggtcgtacaaccttaaatggcgaaggtttacaacacgaagacggtcacagccatattcaagcgggcgttattcctaattgcgttacttacgatccatcatttgcatttgaagttgctgttattatgcaagacggtatcaaccgtatgtacggcgaaaaacaagaagatgtattctattatatgactacattaaatgaagtgatggatcaacctgcaatgcctgctggtgcggaagaaggtatccgtaaaggtttatataaatttgaaacagtggaaggtaaaaaaggcaaaggtcacgttcaattattaggttctggtgcgattatgcgtcacgttcgtgaagcggcacaaattcttgcaaatgactacggtgtgacttcagatgtattttctgcgccttcattcaatgaattagcacgcgaaggtcatgatgcagcacgttggaacttattacacccaacagagacacaacgcgtaccatacgttgctcaagtattagctgatttaccaaccgttgcttcaactgactatgtgaaaggttatgctgatcaaatccgtgcatttgtaccaagtaagcactatcatgtattaggtacagacggtttcggtcgttcagatagccgtgcaaacttacgtgaacacttcgaagttgatgcacgttatgttgtggttgctgcactttctcaattagcgaaagaaggtacagtatctaaccaagtggttgcagatgcgattgcgaaattcggtttgaatgtagatcgtatcaatccgctttatgcgtaa

SEQ ID NO: 2484 - DNA, 1698 bp, H. influenzae strain 86-028NP
atgtcaaaacaaattcaaattcctgatattggtagtgatgaagttaccgtaacagaagtgatggtaaacgtaggcgataccatttctgttgatcaatctatcattaacgttgaaggcgataaagcttcaatggaagtgcctgcaccagaagcgggtgttgtaaaagaaattttagtgaaagtgggcgataaagtttcaactggtactccaatgcttgtattagaagcggcaggtgctgctccagcagctgatgagcctactgctccagtagctgatgcgcctactgcaccagtggttgctaccgcaccaacggcttcagctattgtagaagtaaatgtgccagatattggtggcgatgaagtcaatgtaaccgaaattatggttgcagttggcgatacaatcactgaagaacaatctttaattagcgttgaaggcgataaagcctcaatggaagttcctgcaccattcggcggtgtggtaaaagaaattttagtgaaatcaggcgataaagtttcaactggttcattaattatgcgttttgaagtactaggtgcagctccagcagcatcagcatcagcttcaacatcagcaccacagacagcagctcctgctactactgcacaagcaccacaggcagcagctcctgctactactgcacaagcaccacaggcagcagctcctgatactactgcacaagcagctcaatcaaataacaacgtatctggattaagccaagaacaagtagaagcaagtacaggatatgcacacgcaacaccagttattcgtcgtttagctcgtgaatttggtgtaaatctagataaagtaaaaggtactggtcgtaaaggtcgtatcgttaaagaagatattgaagcttatgtgaagaccgcagttaaagcttatgaaagcggtgcaacagcacaagctactggcaatggtgtagcaaatggtgctggattaggcttattgccatggccaaaagttgatttcagtaaatttggcgaaattgaagaagttgaattaagtcgtatcaacaaaatttcaggtgctaacttacatcgtaactgggtaataattccacacgttactcacttcgataaagcagatatcacggatttagaagcattccgtaaagaacaaaatgcgttagcagaaaaacaaaaactcggcgtaaaaatcacgccagttgtgttcattatgaaagcggtggcaaaagcattagaagcgtatccacgtttcaatagctcaattaccgaagatgctcaacgcttaatcctgaaaaaatatattaacatcggtgtcgcagtagatacgccgaatggcttagtcgtgcctgtattcaaaaatgtgaacaagaaaggcattatcgaactttcacgtgaattaatggaagtatcgaaaaaagcacgtgaaggcaaattgactgcatctgatatgcaaggtggctgtttcaccatttcaagtcttggtggtattggtacaacgcactttgcgccaatcgtaaatgcgccagaagtagctatccttggtgtgtctaaatcatcaatggagccagtatggaacggtaaagaatttgcgccacgcttaattcttccaatgtcattatcattcgaccaccgtgtcattgatggtgcagatggagctcgtttcattagctatcttggctctgttttagcagatttacgtcgcttagtaatgtaa

SEQ ID NO: 2485 - DNA, 1425 bp, H. influenzae strain 86-028NP
atgagtaaagaaattaaaacccaagtcgttgtacttggtgcaggtcctgccggttattcagccgcattccgttgtgcggatttaggattagaaactgttattgttgagcgttattcaaccttaggtggggtgtgtttaaacgtaggttgtattccatctaaagcgttattacacgttgcaaaagtaattgaagaagcaaagcacgctaataaaaatggtatttattttagtgaaccacgcattgagctagatgaagtacgtgcaggtaaagaagctgttgttgctaaattaactggcggtttagcaggaatggcaaaagcacgtaaagtgactgttgttgaaggtttagcgacttttaccgattctcacacattagttgcgcgtgatcgcgatggaaacccaacgactgttaaattcgacaatgccattattgcggcaggttctcgtccagttcaattaccctttatcccacacgaagatcctcgtatttgggattcaacagatgcacttaaattaaaagaagtaccgaaaaaactacttattatgggcggtggtatcatcggtttagaaatgggtactgtatacaatgctttaggttctgaagttgaagttgttgaaatgttcgaccaagtgattcccgcagcagataaagatgttgttggtatttacactaaacaagttgagaaaaaattcaagttaatgcttgaaaccaaagtgactgcagttgaagcaaaagatgatggtatctacgtttcaatggaaggcaaagcctgtaatgacaccaaacgttatgatgcagtacttgtcgctatcggtcgtgtgccaaatggtaaattgattgatgcaggtaaagcaggcgttgaagtagatgatcgtggttttattcacgttgataaacaaatgcgtaccaacgtgccacatatctacgcaattggggatattgtaggtcagccaatgttagcacataaaggtgttcacgaaggtcacgttgccgcagaagtcattgcaggacaaaaacactacttcgatcctaaagtaattccatcaatcgcttataccgaaccagaagtggcgtgggtaggtaaaactgagaaagaatgtaaacaagaaggcttaaactacgaagtggctaaattcccttgggctgcatcaggccgcgcgattgcatctgaatgttcagaaggtatgacgaagttaatctttgataaagatacgcatcgtatactgggcggtgcaatcgtaggttctaatggtggggaattattaggcgaaattggtttggcaattgaaatgggttgtgatgcagaagatatcgcattaactatccacgcacacccaacgttacatgagtctgttggcttagctgcggaagtatttgaaggctcaattactgaccttccaaatgcaaaagcgaagaaaaaataa

SEQ ID NO: 2486 - DNA, 108 bp, H. influenzae strain 86-028NP
atgctcaaaagtgcggtaaaaaaaagaaacgtttttagattggcattctatcataaaaaaatagaaagagaggaaaataaaaatccccaattggggatttttatttag

SEQ ID NO: 2487 - DNA, 543 bp, H. influenzae strain 86-028NP
atgactacacaacttgatttaatcaaatcttctatcaaatcaattcctaattatccaaaagaaggcattatcttccgcgacattacgacccttttagaagttccagcagcttttaaagcaacaatagatcttattgtggaacaatatcgcgataaaggaattaccaaagtgcttggaactgaatctcgtggttttatttttggtgcccccgttgccttagcactaggtttacctttcgaattagtacgtaaacctaaaaaattaccacgtgagactatttctcaatcttatcaattagaatatggtcaagatactttggaaatgcacgttgatgcaatttcagaaggtgacaatgttttaattattgatgatttattagcaactggtggcacagttgaagcgacagtaaaattagtgcaacgtttaggtggagcggtaaaacacgctgcatttgtgattaatttacctgaattaggtggcgaaaaacgcttaaataatttgggcgttgattgctatacactcgtcaattttgaaggtcattaa

SEQ ID NO: 2488 - DNA, 2067 bp, H. influenzae strain 86-028NP
atgagctatcaagtcttagccagaaagtggcgaccaaaaacatttgctgatgtcgttgggcaagaacatattatcacggcattagcaaatggattaaaagataatcgactacatcacgcttacctcttttcaggcacgcgtggtgtaggaaaaacctctattgctagattattcgcgaaaggattaaattgtgttcacggtgtaacggcaacgccttgtggcgaatgtgaaaattgtaaaactattgagcaaggcaattttattgatttaattgaaattgatgcggcgtctcgcacaaaagttgaagacacgcgtgaattattggataacgtgcaatataaaccagttgtgggcagatttaaggtttacttaatcgatgaagtccatatgctatctcgtcattcatttaatgcgttgctcaaaactttagaagaaccgcccgaatatgtaaaatttttactcgcaacaacagatccacaaaaactacctgtaactattctttctcgctgtttacaatttcatcttaaagcattagatgaaactcaaatctcccagcatcttgcccatattttgacgcaagaaaatattccttttgaagagcctgcattagttaaacttgcaaaagcggcgcaaggaagtattcgtgatagtttaagtttaacggatcaagccattgcaatgggcgaccgacaagttacgaataatgttgtaagcaatatgttagggttgcttgatgataactattctgttgatattttatacgccttacaccaaggcaatggcgaactcttaatgcgaacactgcaaagagttgcagatgcggcaggcgattgggacaaattacttggcgaatgtgcagaaaaattacatcaaattgcactcatgcaacttcttccacaaaaatcttcagatgacaatgaacatttttcatttttagccaaacatatctctccagaagatgttcagtttttttatcaagtgattgtttctggtagaaaagatttatcaaatgcgccaaatcgtcgtattggagcagaaatgacattattgagggcattggcattccacccaaagttccttacggcagtaccaaagactaacactacaattactccaccgccatcaacgccaagtgcggttgaaaatactggtaattatgtagatgtgccagtactgtcgcaaagtataaaatcagcttattctcaagcaaaaccaaataaaacgagcattccaaatttggcaagcctttccgctttagatgcgctggaacatttaacacaactcgaaaaccaagaacgtcaagaacacaaagctgaatcattagctgtagtaagtgaaactttacatcacatccaagaactggatgaagaaaaatctcataaaaaaatgaccgcacttcccgtgcgagaaatgactgaaccaaagcccaagcacatagaaaaaccaacatcaccaccaaatgccgcacaagctccacaagaaaatagcacagaagaaaattcaagtgatgataatgcagaagttgctcaagatgaacaagaaatcttgagtgctgacacctatcgttgggaatggagcaatccagaacttgctaaagccgatacaggcgttcgtccttctgatataaaacaggcgattttaaaagatattacgcctgaattacgtttaaaaatcatcacccaaactcaacaacaagatgagtgggcagatatagttgaacgttctggcgtaacaggatttagcaaagaattagcgttaaattgtttcttacaaagcaaaaccgatgatgaaatcaatcttggactacattcagaaaaatctcatttacgccaagacagaagtataaaaaatttggttgaagctttaagtaaattgcaaggtaaagatattcgattaacaatcaatcttgatgatagcaatgtcgcgacgccaattgaatatcgccgtaatatttatcaagcattgcgggaaaaagctcaaaatgaattgcaaaaagatagcaaactacaaatgttgcttaatgaattcgatgcaaaattagatgtagagagtattcgaccagtttaa

SEQ ID NO: 2489 - DNA, 627 bp, H. influenzae strain 86-028NP
atgaaactagttgaagtaaaacacccacttgtaaaacacaaactaggtgtgatgcgtgaagctgagattgatacaaaaaaattccgtgaactggcaacagaaattggtagcctattaacctatgaagcaacctctgatttagaaactgaaaaagtaacgatcaacagttggaatggccctgtagaaattgatcgaattaaaggtaaaaaagtaacggttgtgccaattttacgtgctggtttaggtatgatggatggtgtacttgaacatgtaccaagcgcgcgtatcagtgtagtgggaatctaccgtaatgaagaaacccttaagccagtcccttattttcaaaaattagctagcgatttagaagaacgtcttgcaattgttgtcgatccaatgcttgcaacaggcggttctatgattgccaccctcgatcttttaaaagcaaaaggttgtaaacatatcaaagtattagtgttagtggctgcaccagaaggaattaaggctcttgaggctgcgcaccctgacattgaactctactgcgcttctattgatagccatttaaatgaacaaggttacattattccgggtcttggtgacgcgggcgataaaatttttgggacaaaataa

SEQ ID NO: 2490 - DNA, 1245 bp, H. influenzae strain 86-028NP
atgacaaaccaaacttcttcttttccttcggaaaatcaaagcaaattaaaacaatctttcgttggcctacaaatgctcttcgtcgcatttggtgcgcttgttcttgtaccattaattacaggacttgattccaatacggcattattaacagcaggcgttggcactctacttttccaattttgtacaggcaaacaagtgcctattttcttggcatcatcttttgcctttatcgcgcccattcaatatggtgttcaaacttggggtattgcgactacgatgggcggtttagcgtttactgggcttgtttatttcgccttgagtacgttagtaaaattacggggagcagaagcactacaacgttttttcccaccagtggttgttgggccagtaattattatcattggcatggggcttgcacctattgcggtggatatgtcattaggtaaaaacagtaactatgcttataacgacgcagtattagtttcaatggtaacgcttcttaccactttatctgtggctgtatttgccaaaggattgatgaaacttattccaataatgttcggtattaccgtaggctatattttgtgtttgtttctgggtttaattaatttccaaccagttattgatgcaccttggttcagtttgcccaaattaacgacacctgaatttaacctagaagctattctttatatgttaccaattgctattgcccctgccgtagaacacgttggtggtattatggcgattagctctgtgacaggtaaagattttctaaaaaaaccaggattacaccgcactttattaggcgatggcgtcgctactgctgcagcttctttagtgggcggtccgcctaatacgacttatgcggaagttactggtgctgtgatgctaacacgcaactttaacccaaatattatgacttgggctgctgtttgggctattgcgatttcattctgtggaaaagtaggcgcattcctatcaaccattccaacgattgtaatgggtggaattatgatgcttgttttcggttcaatcgcagtcgtgggcattagcaccttaattcgtggcaaagttgatgttaccgaagcgcgtaatctatgtattatttctgttgtaatgacatttggtatcggcaatatgtttgtagatgtgggtaacgtatcactaaaaggtatcagcttatgtgcgattgttgctatcatcttaaaccttgttttaccgaaagcaaaaaatgaagtagaataa

SEQ ID NO: 2491 - DNA, 696 bp, H. influenzae strain 86-028NP
ttgaataaacagcttcccttacccattcatcaaattaatgatgccacattagaaaacttttacggcgataataatcttttattgcttgattctttacgcaaaaattcatctgatttaaaacaaccgtttttctacatttggggagataaaggctctggtaaaacccatttacttagagcattcagtaacgaatatttaatcaatcaacgtactgctatttatgtaccccttagcaaatctcaatatttttctaccgcagttcttgaaaatttagaacagcaagaattggtatgcttagatgatttacaaagcgtcataggaaatgatgaatgggaattagctatttttgatctattcaatcgaattaaagcaagcggaaaaacgctgttactaattagtgcagataaatcgccttccgcactttctgtaaaattacctgatttaaactctcgcttgacttggggcgaaatttatcaattaaattcattaacagatgaacaaaaagtcgaagtactacagcatacagcttaccaacgaggattccaattatctgacgaaactgcaaattttttaattacacgactagcacgagatatgcatactttatttgaagcacttgatctactagataaagcatcattgcaagcacaacgaaatctcacaattcctttcgtcaaagaaattttaaatctataa

SEQ ID NO: 2492 - DNA, 282 bp, H. influenzae strain 86-028NP
atgtcagattttgttttagtgtattctacagatgtggggcgaattaaagaggaaaaggcttctgtagttcgcccaaaaggagacggtgttgtacgtatccaaaaacaaacaagtggtaggaaaggtgctggcgtatcggttataactggtttagatttatctgacgaggatttgaaaaaattagctgcagaattaaagaaacgttgtggatgtggcggatcagttaaaaatggtattattgaattcaaggggaaaaacgagatttgctcaagcaattattag

SEQ ID NO: 2493 - DNA, 693 bp, H. influenzae strain 86-028NP
atgacaagcaaaattattgtggcattggattatgagaaagaagcagaggctcttgctttagttgatcaaattgatccaagtttgtgtcgattaaaagtgggtaaagaaatgtttactacacttggtattaattttgtaaaacaattacatcaacgtaactttgatgtttttttggatcttaaatatcacgatattccaaatacggtagcaagagcagttcgttctgctgctgatttaggcgtatggatggtggatttacacgcaagtggtggtttgcgtatgatggaagaggcgaagaaaattcttgaaccttatgggaaagatgcaccattgcttattgccgtgacggtattaaccagtatggaagatttggatttattacaaattgggattaatgcatcgccaatggaacaagttttacgcttagctcatttaacccaacgggcgggtttagatggtgtagtctgttcccctcaagaagttgaaattttacgtaatacttgtggtaaagagtttaaattagttacaccggggattcgtccaataggaactgattttggtgatcaacgacgtgtgatgacgcctactgcagcaattcgtgcaggttcagattatttagttattggacgccctataactcaagcggataatcctgcggaggttctccgttctattaatgtatctattgggtaa

SEQ ID NO: 2494 - DNA, 1191 bp, H. influenzae strain 86-028NP
atgatagaattactctttctattattgcctattgctgctgcctatggctggtatatggggcggcgtagtgcgaagaaagatcaagatgacataagtaataaactctcccgagattatgttacgggagtgaattttttactttctaatcaaactgataaagctgtagatttgtttttagatatgttgcaaaagcaagaaatcgaaaatgaaatcgaaagccactcccaatttgaagccgagcttacacttggtaatctgtttcgttctcgaggcgaagttgatcgtgcattgcgtattcatcaagctttagatcttagtcctaattatacttttgaacaaaaattacttgcaaaacaacagcttgctcgagattttatggtggttggtttttttgaccgagctgagaatctttatattttactagtagatgaacctgaatttgcagaaaatgctttacagcaacttttagtgatttatcaaaaaacaaaagaatggaaaaaagcagtcaatattgctgaaaaactcgctaaaataaagccacaagagaataatattgaacttgcgcaatgttattgtgaatattcacaaagtttagaacctgaaagtgcggttgaaaaacgcagtgttttacaaaaggctttgtcggtttctccgacttgtgttcgcgcttctttattgcttgcaaatttagcaatgcttgatggtcaatatcaacaagcagtagaaattttagaaaatgttttggagcaaaatccagattatacgggtgaaattttgtcacctttaaaacattgttatgaagaattaaatcagttagataattttgagttatttttaattcgtgcaggtcaaattattaataatgatgaagtagaactagctctagtcaaattaattgaagaaaaagatggtaagtctgctgcgcaagctaagctttatcaacaacttacaaaaaatccaagtactttaattttccatcgttttatgcagtatcaaattgatgatgcagaagacgggcggggaaaagaaagcttaattttattacataaaatggttggcgaaaggattaagcaaacatcgccttatcgttgtacaaattgtggttatcaaattcataagctattgtggaattgcccatcttgccgtcaatgggaaagtattaaaccggtttcaaatcaagaacataattaa

SEQ ID NO: 2495 - DNA, 294 bp, H. influenzae strain 86-028NP
atgattaaatatattttaggcattgtgatctttattgcgattgtgttagttgcaattaccattggtgcgaataacgatcagattattacatttaattatattgtggcagaaagtcagtttcagctttcaagcctcgttgcaattttatttgggttaggtttaattcttggttggttaattactgcttttttctatattaagttaaaattaaaaaatatggcactagctcgtcaagtgaaacgtcagactttacaaatcaatgaattgacgactacgcgcgataaggtcgcttaa

SEQ ID NO: 2496 - DNA, 285 bp, H. influenzae strain 86-028NP; identical to SEQ ID NO: 645

SEQ ID NO: 2497 - DNA, 1650 bp, H. influenzae strain 86-028NP
atgtcagaatcttttgctcaactttttgaagaatcattaaaaggccttgaaactcgtcaaggttcaatcgttagcggtactgtagtagctatccaaaaaggctttgtgcttgttgatgcaggtttaaaatctgagtctgcaattccagttgctgaatttttaaatgcacaaggcgaacttgaaatccaagttggcgatactgtaaatgttgctttagatgcagttgaagatggtttcggcgaaactaaactttctcgtgagaaagctgttcgtcacgaatcttggattgaattagaaaaagcttacgaagaaaaagcgaccgttatcggtttaatcaacggcaaagtgaaaggtggcttcacagttgagttaaacggtgttcgtgcattcttaccaggttctttagttgatactcgtccagcgcgtgaagcagatcacttacttggtaaagaattagaattcaaagtaatcaaattagatcaaaaacgtaacaacgttgttgtttctcgtcgtgcagtaattgaatctgaaaacagccaagaacgtgaacaagtattagaaaatcttgttgaaggttcagaagttaaaggtatcgttaaaaacttaactgagtacggtgcattcgttgatcttggtggtgttgatggtttattacacatcacagatatggcttggaaacgtgttaaacacccaagtgaaatcgtaaatgttggcgatgaagtaactgttaaagtattaaaattcgataaagatcgtactcgcgtatctttaggcttaaaacaattaggtcaagatccttgggctgcaattgctgaaaatcatccagtaaacagcaaattaacaggtaaagtaactaacttaactgactatggctgtttcgttgaaatcttagatggcgttgaaggtttagttcacgtttctgaaatggattggactaataaaaatatccacccatctaaagtggttagcttaggcgatactgtagaagtaatggtattagaaattgatgaagaacgtcgtcgtatttctttaggcttaaaacaatgtaaagctaacccttggactcaatttgctgatactcacaacaaaggcgataaagtaacgggtaaaatcaagtctatcactgatttcggtatcttcatcggtcttgaaggtggtatcgatggtttagttcacttatctgatatttcttggagtatttcaggcgaagaagctgttcgtcaatacaaaaaaggtgacgaagtgtcagctgttgtattagctgttgatgcagtaaaagaacgtatctctttaggtattaaacaacttgaagaagatccattcaataactttgttgcaatcaacaaaaaaggtgcggtagtatctgcaactgttgttgaagcagatgctaaaggtgctaaagttgaattagcaggtggtgttgaaggttatatccgttctgctgatttaacaagtgaagtagctattggcgatgtggttgaagcgaaatacactggagtagatcgtaaatctcgcattgttcacttatcagtgaaagcaaaagatcaagctgaagaagctgcggcagttgcaagtgtaaataacaaacaagaagatattgttattccaaatgcaatggctgaagcatttaaagcagctaaaggtgaataa

SEQ ID NO: 2498 - DNA, 795 bp, H. influenzae strain 86-028NP
gtgaaattaactttattagataagccatacaaaacatggaagctagtaataatctctaggatggtaatgaggggaaattgtctctataatgcgcaaaattttgataatgaaaggataatttgtatgggaatgattattactgttgatgggcctagtggtgctgggaaagggacgctttgttacgcgttggctgaaaagttgggctatgcactgttggatagtggggcgatttatcgcgttactgcattggcagcgttgcaacgtaaaactgatctaacaaatgaaacagatttagcagaattagcacgtcatttagatattcaatttattcctcaaaatggcgaggtaaacattttgcttgcaggaatggatgtgagccgtttaattcgcacgcaagaagtggcagatgctgcgtcaaaagtagcagtttttcaaaaagtgcggtcagctttattacaacttcagcaagattttgcgaaaaatgatggattaattgcggatggtagagatatgggaacagttgtattcccaaatgcacaagtaaaattatttttagatgcaagtgctgaagaacgtgcaaaaagacgctataaacagttgcaaaataaaggaataaatggtaactttgcacagattttagccgagataaaagagcgtgatcttcgtgatagaaatcgtgaagttgcgccgctaaaaccagcggatgatgctttattattggatagcacagccttgagtatcaatgaagtgatcgatcaggcgttgtcttatattcaagaaaaggtatcagtttag

SEQ ID NO: 2499 - DNA, 876 bp, H. influenzae strain 86-028NP; identical to SEQ ID NO: 635

SEQ ID NO: 2500 - DNA, 579 bp, H. influenzae strain 86-028NP
atgaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtccaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataagtactttatcgatatatgtaaagtagcataa

SEQ ID NO: 2501 - DNA, 1695 bp, H. influenzae strain 86-028NP
atgtctgttcaacaactcatttcacgactgaccgatattgttggatctcgttatattattactgatccaactaaaacagaagcttatcgaagtggttatcgatttggaacaggaaacgccctagctgttgttcgccctgccactctacttgagttttggaacattgtaaaagtttgcgttgaacatgatgttattgttataaaccaagcggcgaatacaggtttaactggtggctctacaccagatggcaatgattatgatcgcgatattgtcgtcatcaatacaatgcgaattgacggaatcaaactcatcaataacgcttcccaagttatttgcttaccaggctctacactcaatgaattagaaaatcaacttaaaccgtttggtcgtgaaccccactctgttattggctcatcttgcattggcgcatcagttattggtgggatttgtaacaactcaggtggagcattagttcaacgtggaccagcctatacagaaatggcactttacgctcaacttaatgaaaaaggtgaattagaactaaaaaatcatttaggcattgatttaggagaaactcctgaagaaattttaactaatctacaagaaaaacgttatcaggttaaagatattcgacaagattgcggacatggtcacgaccattactactgcaactatgttcgtcaagttgatgaaggctcccctgctcgttttaatgccgacccagctcgccactatgaagcctcaggctgtgcaggaaaacttgctgtctttgcggttcgtttagacacctttccgcttgaaaaagagacggctgttttctatatcggcaccaatcaaacttctgtgttgagcgatattcgtcgccacatgttagtaaacttcgaagtgctacccatttcaggtgaatatatccatcgtgatgcatttgacatcgcagcaaaatatggcaaagataccttttgggtcattaaaaagtttggtacacattggctaccaaaactcttttccttaaaatcaaacgtggatcgcatcggcaaaaaattcttctttttaccacaacatttaagcgataaacttatgcaaactgtgtctaaattcatcccagaacatcttccacaaagcttatgggattatcgcaacaaatacgagcatcacttaattatcaaaatgggtggaaaaggcattcaagaagcccgtgaatatttggaatcctacattgcagatggctcaaaaggtggctattttgaatgtaatgcaatcgaaacccaagcagcaatgcttcatcgtttcgctgttgcaagtgctgcaattcgttatcgtgcaattcacgaaaaagaagtagaagaaatagttgctttagatgttgcattacgtcgcaatgatcaagattggtttgaagtgttaccgccagaaattgataacagaattatctctaaactttactacggacattttatgtgccatgtctttcaccaagattacattgtaaaaaaaggttatgattatgaagaactagaatacgaaatgttgaaattacttgacaagcgtggtgcgcaatacccagccgaacacaatgtagggcatttatacgaggctaaaccaaccttgagaaaattctataaagagttggatccaaccaatagctttaatccaggtattggtaaaacgacgaggaaaaaatactgggcggaataa

SEQ ID NO: 2502 - DNA, 111 bp, H. influenzae strain 86-028NP
atgccaaacgaacgtaatattcaaaattatcactcgacttacaacaacattcgggattggcttggttatcaaaaagctggcgaggaaaaagcaaagtcgaccatcaattag

SEQ ID NO: 2503 - DNA, 552 bp, H. influenzae strain 86-028NP
atgttgaaaagaattttagttattattggtttagctgtattagcaaccgcttgttctaatgcaccacgaacggtaagtcatcaggttatttcagaaaatgatgatattcaattaactggtttaattaataatttagaaaaagataatcgaacaggcatttttcacaaagtgagaacaaaccgttcctctgctttgatgggcgataaggctctagccagtgtttataatgaatgggttggcactcgctatcgtatgggcggtacgactaaacgtggtattgattgttcagcatttatgcaaactactttttctgaagtttttggtattgaattgcctcgttctacggctgaacagcgtcatttaggtagaaaaattaataaatcagaacttaaaaaaggcgatttagttttcttccgtaaaaataatcacgttggtgtttatattggtaataaccaatttatgcacgcaagtacagggcaaggcgtgacaataagttcccttgatgaaaaatattgggctagaacctacactcaatcgcgtcgtattatgtaa

SEQ ID NO: 2504 - DNA, 1449 bp, H. influenzae strain 86-028NP
atgttaaaccaagtttcaaatacattactgacaccaagtaatctttcaactcaaacattactcaatatttttgacattatgtcgcatcgcaatattgattatgccgatctgtattttcaacttagccaagatgaaagttgggtattagaagacggcattataaaagaaggcggttttcatattgatcgtggcgttggtgtgcgggctgtttctggtgagaaaacggggtttgcttatgcggatcaaattaatcttgcttctttgcagcaatgtgcggaggcggtaaagggaattgcgcaagtcaaacaggggaatttgatttcgctatccgcttttaatgttgtaaatcctattgctcgttatgcggcgattaatcctttggaaagtttgactaaagagaaaaaaattgagctattacatttggttgatcgtacagcacgcgcagaagatcatcgtgtaaccaaggtttcagcaagcctcagttctgtttatgaagaagtattaattatggcgacagatggcacattagccgcagatattcgtcctttagttcgcttatctatttctgtgttagtagaggaaaatggaaaacgtgaacgaggaagttgtggttctggtgggcgtttcggtttagattggttctttgaagttgttgatggcgatattagagcagtactttttgctaaagaagcggttcgtcaagccttagtaaaccttagtgcagttgcagcacccgcaggattgatgcctgttgtgttaggtgcgggttggccgggcgtattgctacacgaagcggtaggtcacggtttagaaggcgattttaaccgtaaagaaagttcactttttacaggcaagattggtgagcaagtgacttcaccgttatgtacgattgtggatgatggcacgattgaaaatcgtcgaggttcactaactattgatgatgaaggtgtgccaagccagtgcaatgtactcatcaaagacgggattttgcaaggttacatgcaagataaaatgaatgcccgtttgatgggcgttgctccaacgggaaatggacgacgtgagtcttatgcccatttaccaatgcctagaatgaccaacacctatatgcttgctggacaaagtcagtttgatgatttgattgcttctgtaaaacaggggatttatgcaccgcactttggtggagggcaagtggatattacctctggtaaatttgtattttctacttcagaagcctatttaattgaaaaaggaaaaatcacgaaaccagttaagggcgcaactttaattggcagtggcattgaagtgatgcaaaagatttctatggttgcagataaatcagaacttgatttaggtatcggggtttgtggtaaagaggggcaaagtgtacctgttggcgtaggacagccagcactaaaaattgatgaaattactgttggtggaacaaattaa

SEQ ID NO: 2505 - DNA, 852 bp, H. influenzae strain 86-028NP
atgactgatttaaccggaattttatacattgttgccacgcccattggcaatttacaagatattacccaacgtgctttagagacttttgctcaagtggatttaattgcagcagaagatactcgccatagtggacttttattgatccattacggcattaagaagccattttttgctttgcacgatcataacgaacaagaaaaagcgcatattttggtggaaaagctcaagcaggggagtaatattgccttgatttctgatgcggggacgccattaatcagtgaccctggttttcatttagtacgccaatgccgtgaagctggcattcgagttgtgcctttgccaggagcttgtgcggcaattaccgctctttgtgcatcggggattgcttctgatagattttgttttgaaggctttttacctgcgaaaagtaaagcacgcaaagataaattagaaaatatcgcagaagaagaccgcactttgattttttatgaatccactcaccgtattttagatacactagaagatatgcaagcggtgctaggggaaggacgctatattgtgttagcccgtgaaatgactaaaacttgggaaacgattacagggaatacgattaaaaatttacgcgaatggcttttagaagatcccaatcgtacaaaaggcgagatggttttgattgtggaaggcaaaccaaagtctgacaataacgatgaaatttcgccgcaagcggtaaaggcacttgagttaattgcagaagaattgccacttaaaaaagcagcagctatagttgctgagttgtatggttataagaagaatgctttgtatcaatttggattagcgcatttggaaaaataa

SEQ ID NO: 2506 - DNA, 1728 bp, H. influenzae strain 86-028NP
atgtctattctattacaaggcgaacgttttaaaaaacgtttaatgccaattttattgtcaatggctttagctggctgttcaaatctacttggtagcaatttcacgcaaaccttacaaaaagatgcaaatgcaagttctgaattttatataaacaaattagggcaaacgcaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgccgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcgtcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgtacccaaaagaattgcttacattgcttaatttccaacaaacgaatgtgtcacaaattggtttactcttgccattaagtggagatggacaaattcttggtacaaccattcaatcgggttttaacgacgcgaaaggtaactcaaccattccagtgcaagtgtttgatacctcaatgaattctgtccaagatatcattgcgcaagcaaaacaagcggggattaaaaccttagtcggcccattactaaaacaaaatcttgatgtgattttagcggatcctgctcaaattcaaggtatggatgtgcttgcattaaatgccacaccacattctcgtgcgattcctcaactttgttattacggactttctccagaagatgaagctgaatctgccgccaataaaatgtggaacgatggcgtgcgtaatccacttgtcgcaatgccgcaaaatgatttaggacaacgcgtaggcaatgcctttaatgtacgttggcagcaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaattctccacaatatcagaagttagcaaaatccacggggggtgaatatcaattgatgcgtttatatgcaatgggtgcagatgcgtggttgctcattaatcaatttaatgaattacgccaagtgccaggctatcgcttgagtggcttaacagggattttaagtgctgataccaactgtaatgttgaacgcgatatgacttggtatcaatatcaagatggtgcaattgtaccagttgcaaactaa

SEQ ID NO: 2507 - DNA, 360 bp, H. influenzae strain 86-028NP
atgttttctttaaaacgtcagcaaggggcgagctttgagcatcaagctcgcctttttttagaatcaaaaggcttaacatttattgcggctaatcaaaatttcaaatgtggtgaacttgatctaataatgaatgacaaagaaactatcgtctttgttgaagttcgccaacgaagtcattccgcctatggttctgctatagaaagcgtagattggcgaaaacaacaaaaatggttagatgccgcaaatttatggcttgcaaaacaaaatatgagcttagaagatgctaattgccgctttgatttaatcgcttttggcaaaacacctcaagatattcaatggattcctaattttctcgattaa

SEQ ID NO: 2508 - DNA, 585 bp, H. influenzae strain 86-028NP
atgttacaaaaagtaaaagatatttatagcgaaagtattcaaattcaaattgcagcatctagcatgctttctgaaaatattaccaatgccacacaaatggtaatgcaatgtttattaggcggtaataaggttatcgcctgtggcgtgtcgcgttcttatgccaatgcacagtttctcgtctcaaacttacttaatcgatatgatttagttagaccaagcttcccgtctgtgttattgagcttagaaagtgcagtgggttcttcacttgtttttgaacaaccgcctgaagaattgtattgtcatcaatttaatgccattgcaaaatcgggcgacttacttattgcttttgcacctttggggacagaaaaaatcgtgctaaatattatttctcatgctgtcagcaaagaagttaatgttattgtgctaactggctctaacaacgatgccattcaaggaattttagcagataaggatctagaaatatcaatcccagccaccaaagaaagtcgtatcttagagaaccatctttttgtgattaatgcactttgtgaattggttgatcagactttattcccaagtgcttga

SEQ ID NO: 2509 - DNA, 582 bp, H. influenzae strain 86-028NP
atgacattatccccgttaaaaaaactcgctatcctgcttggagcgactatttttctacaaggctgtgttgcagctgtgattggaggtggtgctgtagcagctaaagtagctaccgatccccgaacgacagggacacaaattgatgatgaaaccctcgaatttaaagtagaaaatgctgtagaaaaagatgcccaaattaaggctgaaggtcgtgtaaatgcagtgtcttacaatggccgagtacttttaataggtcaagttcctaatagtgatgtaaaagacactgccacagctcttgcaaagggtgttgaaggtgtcaatgaagtttataatgaactaactgttagcccaaaaatctcttttgcacaaatcagtaaagatagttggctcacaacgcaagtcaaatctaagatgttcgttgatggtcgagttaaagccacagatgtcaaagtgattagtgaaaatggagaagtatttttactgggtaacgtcacacaatctcaagccaatgcggcagccgacattgccagcaaaatcagcggcgtgaaaaaagtaattaaagtattcaaatacctagactaa

SEQ ID NO: 2510 - DNA, 2271 bp, H. influenzae strain 86-028NP
atgaataaaagtttaatggttacaaagcgtgacggtacgcaagaacaaatcaatcttgataaaatccatcgtgtgattacgtgggctgctgaaggactagacaatgtttctgtttctcaagtagaacttcgttcacatattcaattttatgaaggcattcgcacttcagacatccacgaaaccattattaaagcagccgcagatttaatcagcaaagattcgccagattatcaatatttagctgctcgtttagcgattttccatttacgtaaaaaagcctatggtcatttcgatccccctcgtttatacgatcacgtcaaaaaactagtacgtatggaaaaatatgatcaagcgttattagatgattatactcgtgaagaatgggacacaatggacggcttcatcgatcattggcgtgatatgacgttttcttatgctgcagtgaagcaattggagggtaaatatttagtacaaaaccgtgtgacgggagaaatctacgagtctgcacaattcttatatttgctggtttccgcaagtctattctctaaatatccaaaagaaacacgtttggattatgtaaaacgtttctacgatgccacatcgactttcaaaatttccttacctacaccaattatggcgggcgtgcgtacaccaactcgtcagttcagctcttgcgtattaattgaatgtgatgacagtttagattcaatcaatgcaacagcatcagctattgtaaaatatgtttcacaacgtgcagggattggtattaatgcaggggctattcgtgcattaggtagcgaaattcgtggtggagaagcattccatacaggttgtattccattctataaatatttccaaactgcagttaaatcttgctcacaaggtggcgttcgtggcggtgcagcaacactttattacccaatttggcacttagaagcagaaaacttgctcgtattaaaaaataaccgtggtgtagaagacaaccgtgttcgtcatatggattatggcgtccagttaaacaaattaatgtatcaacgtttaattaaaggtggcgagattactttatttagtccatcagatgtacctggactttatgaagcattctttgcggatcaagataaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcttttaacttaggtaaaattgaaaacttagatgaattagaagaacttgcggatcttgcagtgcgttcacttgatgccttattagactatcaagattaccctgttgtggcagcaaaacgtagctcacttgcacgccgttcactcggtattggggtcattaactatgcgtattaccttgcgaaaaatggtgttcgctattctgatggttcagccaacgatttaacacaccgcacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccgcgtggacacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttaa

SEQ ID NO: 2511 - DNA, 1131 bp, H. influenzae strain 86-028NP
atggcatacactactttttcccaaaataaaaacgatcaattaaaagaaccgatgttctttggtcaaaacgttaatgttgcgcgttacgatcaacaaaaatacgagacttttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggtcgtagcccgaacgtggcattattgcctttagtgtcgattcctgaattagaaacttggattgaaacttggacattctctgaaaccatccactctcgctcttacacacatattattcgtaatattgtgaacgatccttctatcgtatttgatgacatcgtaactaacgaagaaatcatcaaacgtgcacaagatatttcatcttactacgatgatttaatccgtgatagccaactttatggcttatacggcgaaggcacttataccgtagatggcaaagaatgcgtcgtaactttacgtagtttgaaaaaacaactttacctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtaggtcaaattgactcaaaagttgatacgaatgattttgacgatttttctctctaa

SEQ ID NO: 2512 - DNA, 1230 bp, H. influenzae strain 86-028NP
atgacaatcgaaattcttgttccagacctacctgaatcagttgcagatgcaactgttgccacttggcataaaaaactgggcgatactgtgaaacgtgatgaggttattgtggaaattgaaacggataaagtcgtgctagaagttcccgcactttctgatggtgtactggctgaagttgttcaagctgagggcgaaacagtggtgagtaaacagttgctaggcaaaatttctacggctcaagaaggagatgtcagttcagcgacgttaaaagcaacgaatgaacccacaccatctgatcgtcaaaatgcagcgattgaaaatagtcataatcataatgcggatcagagccctgcaattcgtcgtttattagcagaacatgatttacaagcagatcaaattcaaggttcgggtgtgggtggtcgtttaacacgtgaagatattgaacgtgaaattgcaaaacgacaagcacagcaagtgaaacaagaagctgccactgagcaaaatacaattagtacggtggcttatagcgcacgttctgaaaaacgtgtgccaatgacccgtttgcgtaaacgtattgctgaacgtttacttgaagccaaaaatagtacagcaatgcttactactttcaatgaagtggatatgcagccgataatgactttgcgtaaaacctacggcgaaaaatttgaaaaacagtatggtgtccgtttaggctttatgtctttttatattaaagcggttgtggaagcattaaaacgttatcctgaagtgaatgcttctattgatggggatgatgttgtttaccataactattttgatattagtattgcagtttcaacaccacgtggattagtcacaccagtgcttcgtgattgcgataagctcagtatggcagagatcgaaaaacaaattaaagcattagctgaaaaaggtcgtgatggcaaattaacagtagaagatcttactggcggcaattttactattacaaatggtggcgtgttcggttctcttatgtccactccaattatcaatccaccacaaagtgcgattttaggaatgcacgctattaaagaacgcccgattgcgcttaatggtcaagttgtgattcatcctatgatgtaccttgctttatcttacgatcatcgtttaattgacggccgtgaatctgttggtttcttggtaacgattaaagaattattggaagatccaacaagattgttattagaaatctaa

SEQ ID NO: 2513 - DNA, 2853 bp, H. influenzae strain 86-028NP
atggagcgaaaatattgcttcaaatatcataataaagaggtaattatgcagcagaacaaggcatttgatgattggttagccagcacagcattaggcggtgcaaatcaatcctatatagaagaactttatgaaagctatttgagtgatccacagtcggtggaggaaagctggcgaaaaacctttgattctttgccaaaaaccaccgcacttgaacagccccatactccagtgcgagattattttcgtcgtttagcgcgagaaaatcataatgaagcggtgacagtgatagatcctgctgctggtgcaaaattagtgaaagttctacaatttatcaatgcctatcgttttcgtggccatttagaggctaatcttgatcctctcaattattatcgttggaaagtatcttctgtccctgaattagattatcgccatcacggttttactgaacaagatctcaacgaaactttcaatataaatcattacgtttataaacgcgataccattaaacttggcgaattagctcaaatgttgaaagaaacatattgtggctcaattggcttggagtttatgcacgtgcaggatatggagcagaaaatgtggctccagagcaagatggaaagcctgttagataaaccgctttttacatctgaagaacgtgtcaattttcttcgtgaactgacagctgcagacggtttagaacgttatcttggtgcgaaattccctggggcgaaacgcttttctttagaaggaagtgatgcgtttattccattgatgaaagaaattattcgccattctagtcgtcaaggggtaaatgatgtggtaatgggaatggcacaccgtgggcgtttgaatatgctcgtgaatgtattaggtaaaaagcctgaaaatttattcgatgaatttgcaggtaaacattccagcgaacgtacgggggatgtgaaatatcatcaaggtttttcttctgattttgccgtagatgataagagagtccacttaacgttggcatttaatccatctcatttggaaatcgtaagccctgttgtgattggttctgttcgatctcgacaaactcgtatgaatgatacagaacatagcaaagtgcttgctattactgttcacggagattcagctgtggcaggacagggggttgttcaagaaacattgaatatgtcaaatgcccgtggttacagtgtgggcggtactattcgcatcgtgattaataaccaaattggttttacgacatctaatccgaatgacacgcgctctacagaatattgcaccgatattgcgaaaatgattcaagcaccgattattcatgttaatggcgatgatcctgaagcggtggcatttactgcgcgtatggcggtggaatatcgtaatttattcaaacgagatatttttattgatttaatttcttatcgtcgccatggccataacgaggcagatgaaccattagccactcaaccaatgatgtatagcatcatcaaaaaacatcctacaccgcgtaaagtttatgcagatcgcttagtttcagaaggcgtgatgactgaagaacaagttaccgagatggcgaatgattatcgcgatgcgctagataatggcgatcgcgtggtatctgaatggcgagaaatggatacggcaaaaatggattggttgcaatatctcaattatgattggactgcaccgtatgaaagcaaattttcacaggaacgttttttaacgcttgctaaacgtgtatgtgaatatccagaaagtttacgtgcgcaccctcgtgtagaaaaaatctataatgatcgtaaagcaatgtatcaaggcgaaaaattgctcgactggggtatggctgaaaccatggcttatgcaaccttacttgatgaaggtgttaatgttcgtttatcaggcgaagatgcgggacgaggtacttttttccatcgtcatgccgttgtgcataatcaaaatgatggtacggggtatgtaccattaacacatttacacgccaatcaaggtcgttttgaagtatgggattcggtactttctgaagaatctgttcttgcttttgaatatggctacgcaacaacagatccaaaaactttaaccatttgggaagcgcaatttggcgattttgctaatggtgcgcaaattgttatcgaccaatttattagctctggcgaacaaaaatggggcagaatgtgtggtttagttatgttattgcctcatggctatgagggacaaggccctgaacattcttccgcacgtcttgaacgttatttgcaactttgcgcagaacaaaatatgcaagtttgcgtgccatcaacacctgcacaggtgtaccatatgttgcgccgccagtctttacgtaaaatgcgccgtccattgattgccatttccccaaaatctttactacgtcatccattggcagtgtccagtttagacgagttgattaatggaactttccaaacggtaatcggagaaattgatgagcttgatcctaaagatgtaaaacgtgtggtaatgtgttcaggtaaagtttattacgatgtacttgaacaacgtcgtgcaaataatcagaaagatgtagcgattattcgtattgagcagctttatccattcccgcatgaggatgtgaagaaagcgcttgagccttatgcgcatgtcacggattatgtatggtgccaagaagaaccacttaaccaaggggcttggtattgcagcaaacataattttgaatcagcaattccagaatccgttaaactcaaatatgcagggcgtccagcttctgcttcgcctgctgtgggttatatgtcgcttcacactaaacagcaaaaacagttagtggaagatgcgttgagtttttaa

SEQ ID NO: 2514 - DNA, 639 bp, H. influenzae strain 86-028NP
atgaatattgaaattatccctgttaccgcatttcaacaaaattgttctttgatttgggatgatgacaaaaatgccgcaattattgacccaggtggcgaagccgaacgcctaattcaacgtattgaagaactggatttaaatctcaaagtgattttgattacccatggccatttagatcacgttggtgctgcaatgcaattaaaacaacattttggcgttgaaatttggggttctaatgaaaaagataaatttttatttgagagtttacccgaacaagcccaacgttttggcttgccaaatattgaagcctttttacctgatcgttggtttaatcaagaaggtgaaatcttaaaattagatggctttaatttcgagattttacatttaccagggcatacacctgggcatattggttttattgaacacgagaaaaaagtggcatttacaggcgatgtattatttcaaggcggaattggtcgtaccgatttccctcgcggggattatgaaacattgatttcttcaattcgaacaaaactattaccattgaatgacgatcttattattattgctggacacggatcttacacaaccattgggcaagaaaagcggagcaatccatttttaaattctaaatcctaa

SEQ ID NO: 2515 - DNA, 756 bp, H. influenzae strain 86-028NP
atgttatttgacagccatcttcatttagaccaactctctgatgagaatattcagcaaacacttgctcattcaaagattataggtatgcttgcggtgagtactaatctcaacagtgccaaaaaactgctgaatttaaaacagacttacccaaagaaactttatattgcagctggttttcatcctgaacagcaattacctagtttagaagaacaaaaagaattatttcaatggattgacgaacattattcatcgatttctgccattggcgaggtgggcttgccacattattctaaacgagaaaatccgaatttagattacgtgccttacattgaattactggaacgatttattctgatagcgaaaaaatgggatttaccgttaaatttgcatattgtacataacgatgtagaaattgcccttgaattattgcagaaacacaaaattcaacgggctcactttcactggtttaagacagatgaaaaatcttttcagaaatttttctctaccccctattttgcaagcctaacccctgatattttatggaaccataaaacccaatatgtcgcacaacatttacccttaaatcgcttgatgattgaaacggatagcccttggcaacacgaaggatttgaacgtgcgggcatttctgaacaattattggcagtcttgcaaaaactagctgaattaaagtctttgccattacattctgttcaaaagcaaatgcttttgaatactcaacagttttatcaattataa

SEQ ID NO: 2516 - DNA, 561 bp, H. influenzae strain 86-028NP
atgaattatgtggatcaaaataaacgaaaatggttatcgctgggcggtattgcgttaggaatatctattttaccaaattctgtattagcaatggtttcaacacctaaacctcgtattttaactttccgcaacattaatacgggcgaaagattaagtggcgagttttctttagcaaaaggtttttcgcctgcgatgttaaaaaaattggattatttaatgcgtgataaaaggacaaatcaagtgcataaaatggatccaaatttattccataaattttataatatccaaactaatttaggcttacgcgatgctgaaattgaagtaatttgtggttatcgttcggtcgctactaatgcaatgcgtcgtcgccaaagtcgtggcgtagcgaaaaatagttatcacattaaaggaaaagccattgattttcgtattgcgggtgtgcctttgattaaagtgaaatcttctgcggaaagtctgcgaaatggtggcgtgggttattatccaactagtaatttcattcacgtagatacaggtcctgtgagaacttggaaaggcgtgtaa

SEQ ID NO: 2517 - DNA, 1470 bp, H. influenzae strain 86-028NP
atggtagtgtttaaaagcaccttaaagttatcattattcgccttatcattatctatgatgatgtcgggttgtgttttagtaggtttgagcaaaaatgaccaatctaaatcattgtacggcattaatctttcccatttgtcactcgcagaaagaaaagagcttgaagaagccatttatgcggatcagcaacgtttaacggaagaaaaacaaacattgcttaatatgacgctaacacacgaaataggcgatcataagttacaatttaagcctttactcgcgcgtttatatgcttctcgtaaatatgccccgttatggactgacaatgcggcagctcgtcaattgttacgtgattatgcggcaatggtggcaagcggtatttcaaaatcgtcggcaacttcactagaaacattggcattggtagaacaacaaggcggattggtttatgatgtgttattaagtgatattttgttagattacttatattacacacaaaatgttcgttctcaagcatctaattggttgtattcatctgctcagtatcaagcacaacagcctgaaaatgatcatattcaacgctggttaagtgcggtggaaaataatcaacttcttgatttcatacaaagtttagcgggagaaaatcatttatatcgccaaacagttcaatcattgccgatgtttattccgacttctaaagaatcaaatattgctcaaaaattggcaatgaatgcacagcgtttacgtgtgattcctgattttcataatggaatttttgtgaatattccaagctataaattacagtattatcgtgatggcgatttaattttagaatctcgggtaattgttggcacagattcgcgcaggacacctgtaatgtatagcaaattaagtaatgtggttgtaaatccaccttggaatgcgccaattcgcttaattaatgaagatttattgccaaaaatgaaagccgatccaaattatattacggagcataattattcaattttagataatcaaggcaatgttgttgatcctgcttctattgattgggaatctattggtaataaatttccttatcgagttcgacaagcggctggcgatagtgcgttaggtaattataaatttaatatgccaagttctgatgcaatttatttacacgatacgccaaatcgcggattgtttaatcgtaaaaatcgagcgttaagttctggttgtgtgcgtgttgaaaaatctgatcaattggcaagtattttattaaaagaagcaggttggacagaaactcgaaaaaatacagtattagcaagtaaaaaaaccacttctgcgccgatacgctcggataatcctgtttttttatattatgttactgcgtggattgaaaacggaaatattgtaaatttacctgatatttatggttatgatcgtcagattaatcttgctgagataaattgggatctcgtaaaaaaatatcttcaataa

SEQ ID NO: 2518 - DNA, 2088 bp, H. influenzae strain 86-028NP
atggttatgaaatttaaaatgtcaaaaaatgtgatttgttatgcgtggttatcggtgtgtttgagcagtgcaattcctgcatttgctgtacaacctacattaaaaccaagtgacattagtattccagcgataagtgaagaaagccagttggcaactaagcgtgcaacgacaagattaactcaatcccattatcgtaagattaaattagatgatgatttttccgagaaaatttttgatcgttatattaaaaatttagattttagccacaatacttttttgcagtctgatatagacgaacttcgtcaaaaatatggtactaagttagatgaacagttgagtcaaggcgatctttctgcggcgtttgacatttatgatgtaatgatgaaacgtcgctatgaacgttatacttatgcgttatctttattagataaagagcctgatttaaatggtcaagatcaaattgaaattgatcgtgaaaaagcggctgcgccacaaactgaagctgatgcgaataaactttgggatgctcgtgtaaaaaatgacattattaatcttaaattaaaagataaaaaatggtcagaaatcaaagcaaagcttacaaaacgctataatttagccattcgtcgtttaacgcaaacaaaagcagacgatattgttcaaatttatttgaatgcttttgcgcgtgaaattgatcctcacaccagttatctttccccaagaacagcaaaaagttttaatgaaagtataaatctttctttggaaggcattgggactactttacaatcagaagatgatgaaattagcatcaaatctcttgtacctggtgcgccagcggaacgtagtaaaaagctgcatcctggggataaaatcattggtgttgggcaagcaacaggcgatattgaagacgttgttggttggcgtttagaagatttggtagaaaaaattaaagggaaaaaaggcactaaagttcgcttagaaattgagcctgctaaagggggaaaatcacgtattattactttggttcgtgataaagtccgtattgaagatcaagctgctaaactaacctttgaaaaagtgtcaggaaaaaacattgcggtaataaaaattccaagtttttatattggattaaccgaagatgtcaaaaaactactggttaaattagaaaatcaaaaagctgaggctcttattgttgatttacgtgaaaatggcggtggtgcattaacggaagcggtggcgttaagtggtttatttattgccgatggccctgttgtgcaggttcgcgatgcttatcagcgtattcgtgttcatgaagatgatgatgctacgcaacaatataaggggttattatttgtgatgattaatcgttacagtgcttccgcatcagaaatttttgctgcagcaatgcaagattatcgtcgaggtattatcatcgggcaaaatacttttggtaaaggtacggtgcaacagagtcgttcgttaaattttatctatgatttagatcagagtccgttgggtgttttgcaatatactattcaaaaattttatcgcgttaatggtggttcaacccaattaaaaggtgttgcagccgatattaatttccctgaaattatagatgcgaaagaatatggggaagataaagaagataatgcgcttgcttgggataaaatcccatcagcgagttatacggaagtaggaaatatcgattatattgataatgcagtaaatattctaaatgaaaaacatcttgctcgtattgctaaagatcctgaatttgttgcattgaatgaagaattgaaagtgcgaaatgaacgccgagatcgaaaatttctatcgttgaattataaaatgcgtaaagcagagaatgataaagatgatgcaagacgtttaaaagatttgaacgaacgttttaaacgtgagggtaagaaagcattgaaagatattgatgatttgccgaaagattacgaagcaccagatttcttcttaaaagaagctgaaaaaatagcagctgatttcgttatttttaattcagatcagaaaattaatcaagcaaacggcctatccgaagcaaaaacggaaagtaaaaaataa

SEQ ID NO: 2519 - DNA, 639 bp, H. influenzae strain 86-028NP
atgactgacacacaattatcatctcaagttacagatgtgcaaacggaagtgcaaaaattaaccaacgcaaaagctatcattacttatttagcagaaaaatttcctctttgctttgttttagagggcgaagcaaaaccattaaaaataggtttatttcaagatttagctgaagcattacaagatgatgaacgcgtaagtaaaacccaattgcgtcaggctcttcgccaatacacatcaaattggcgttatttatatggctgtcgtgaaggtgcagtgcgtgttgatttacagggtaatcctgcgggtgtattagatgcagaacacgttgctcacgctgcacagcaacttgctgaagcgaaagcgcgttttgcggaaaaacgtaaagcagaagctgtagctaaaaaagcacaacaaaaaaagcatccgcgtaaacctgcgaataaaaaccttaaaaaagagagtaaattatcactaagtgcggttgatttttcacaaatttctgttggttctgttgtgaaagttaaagctggagataatgctaaaaaagcaacagtggtagaagtattaaaagattcagcacgtgttgaacttgaaaacggtttgattatgaacgttgctgcagatcgtttatttgcttaa

SEQ ID NO: 2520 - DNA, 1251 bp, H. influenzae strain 86-028NP
gtgcctaaaacaaagctaacttcgcctccatttaaaattttaaaatgcacagaatgtgatgcttgcattaacgtgccttctattcttcaatcaaatgaacaagccgaatgcccacgttgtcatcatctattagaaagtagtacgaggtggtcattacatcgttgtgcaatgattgcattatctattttgatattaatgcccttttccttgaattaccccttattaagtttacatttattgggtattaaaattgatgcctctatttgggatggcatttggaaaatggcagtgggtggttatgaatacactgcgtttatgatctttatttgtgcagtagtaatgccgattacgtttgcacttttagtgattatgctttggctggctaagatttttcagataaaacctcgtagtgttttactatttcttggttacattaaagcttgggtaatgtttgatgtttatttagtggcactcggagtaaccatatttaaagtacgcgaatatgcaacattagaaattaatatttatttaattccttttatttttaccgcacttttaactacgttgctttttatcaaacttaatctttccgccttatggcaggaattttatcctgaatgcacttcagtttatacaaaacaagctgttgaattatgtcctgcttgccactacacctttacgcaaaaatctatctattacgatcatcaacaaaagatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggtgcattttattttggtgcagccgtattttgcactatgctttccacctcacaatttgatagcaaattaatttggaaaatttatgacagagaaaaataa

SEQ ID NO: 2521 - DNA, 2646 bp, H. influenzae strain 86-028NP
atgacagagaaaaataattcctcctcaatagaagaaaaatatcaagaaataacagcgaacttacgtaaaacaaaacgcatttcgcctttttggctattgccttttatcgcattatgtatcggggcaattttattcttccaaattgtgaaagaacgtggtactagcattacgattacctttaccaatggttcaggtatcgttgcggataaaactcaaattcgttatcaaggattacaaattggcatagtaaaagaagttcatttcactgataacctgcaaaaagtggaagttgttgccaatatcaatcctgaagcatcaagtattttgcgtgaaaatacaaaattttggcttgtgcaaccaaatgtttctcttgctggcatttcaggattagattctctcgtgtcaggtaattacatcactcttcaaccgggtgatggcgatcgtgaagatgaatttatagcagaagaacaaggccctattgcacaagtttccgcaggagatttattgattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatgttagtggcattaacgcgaacattagcccatcaggcttaaacctaaatgtagaaagtttaaatgccgttgtacagggggcggtttcttttgactctccagctgacagcccaaaagcagatgaaaatagtcatttcacgctctataccaatttaaaagcggctaaacgtgggattgaaattaaggtaacaattcctgcctcatccgctcttattgcagggcaaacggaagtttattctcaagataatgctatagggattctcgccaagctaagtgcggtggaaaataacgatgaaattttagaaggcagtttattgatcgatccaaaccaagcctctttgtttaaagcaaatagtaaaattgtcctacgcaataaaaaaatggatctaggcaatttagcagaaccaaaaaaattctttcgtgacgaatattttgatgtgattgcgggagacggcgaaactaaacatcaatttaacgtgattaaagaaaatgaattattactcaatgcgcctaacacgttagttttaaccctcactgcgccagagaattacggcgtcagcgaagggcaaaatgtgttttataacaatatgataattgggcaaattgtttcacaaacaattgatgtaaatggcgtgcaatttaaagcagcaattgcctctgaataccgtaatttaattcacgaagatactcaatttgtggctgcaaccaatttcgatataagcattggattagatggattgcgttttgaatccgcgacaccagaaaaatggttacaaggtggtgttcgagtactaacaaaacaagctcagggaaaagctaaaaccagttatccactttatcaaaatattagcaatgcagaacacggtattacaggcgatattcttacgccaacaataaccttacatacccaaacattaccaagtattgataaaggttctctcgtactatatcgtcaatttgaagtaggaaaaattttaagtattaaacctaaaacgaatagctttgatgtagaaatttatatttatcctgcctatcaacatttattgacagataaaagccgtttttgggtagaaagtgcggcaaaaatagatgtcagtccaaaaggtattagtattcaagcaacgccacttgcacgttccttaaaaggggcgattagctttgataatggcggttcaggcaataatcgaacactttatgcaaatgaaagctatgcaaaatccatcgggtttgtcatcacgttaatcacagatgatgcaactaatcttagcaaaggaatgaatctgcgctatcttggcttagatgtggggcaaattgacagcattcatcttgatgcaaaagcgaaacgcatcactgcaaaagccctaataaatccaaattatatgaatataattgcaaaagaaggggctaattttacgataatctcgccacaaatttcggctggtggaatagataaccttgatagtttattacagccttatattgatattgaaattggtaatggaaacacaaaaacacaatttaatttagcacaaacggcaccacaacgtaataaatttagcaatggcacgccgtttattttagaaacgcgtgatgcgatgaatttaagtgaaggttcgccaattctttatcgaggtgtagaagttggcacagtgaagaaatttgaacttaatagtcttggtgatcgtgtgttagtgcatattgccattatgccgaaatatagccatcttgttcgacaaaacacagaattttggatcgcatcaggctacgactttagcttaggctggaaaggtgcggtatttaatacgggtagcgttcagcagttgctaaaaggtgggatttctttctccacaccagcagaaaaagaaattcaaccgcaagcgcagcccaacaaacgtttcttgcttcaaataaaccgccctgaagaagtgcaaacttggggaagtggtgcgttatcaaaataa

SEQ ID NO: 2522 - DNA, 453 bp, H. influenzae strain 86-028NP
atgacggatattcaaatttcggtacaagaacagccttttgatcaaaatgccgtttatcaatggctttctgaacaacattcggttggtgcaacggttatatttgttggtaaagtacgcgatcttaatttaggcgatgcagtatctagtttgtatttagaacattatcccgcaatgactgaaaaagcgttgaatgaaattgttgcacaagcgacagcgcgttgggatattcaacgtgtatcggtaattcatcgtgttgggcttttacaaactggcgatgaaattgttttagtgggggtaagttccgcacatcgtggagatgcttatcacgccaatgaattcattatggattttttaaaatccaaagctccgttctggaaaaaagaacaaaccaatcaaggcgagcgttggattgaagcaagagagagcgataaagaagcattagaaaaatggtaa

SEQ ID NO: 2523 - DNA, 246 bp, H. influenzae strain 86-028NP
atgttaaatattttattttttgctcaaactcgtgaattaattggcgttgatgccattcaattagaagatgattttgccactgcggaagcggtgcgtgaacaccttgctcaaaaaggcgataagtgggcattggcactggaaaaaggtaaacttttagtggcaattaatcaaaccttaatgcctttagaaagtgcggtaaaaaatggcgatgaaattgcctttttcccaccagtaacagggggctaa

SEQ ID NO: 2524 - DNA, 483 bp, H. influenzae strain 86-028NP
atgactacatttacacatatcaattctcaaggcgaagccaatatggtggatgtttctgcaaaggcagagacagttcgtgaagcccatgctgaagccatcgttaccatgtctaaagaaacccttgctatgatcgtggaaggtaaacatcacaaaggcgatgtttttgctacggctcgtattgcgggtattcaagctgcaaaacgtacttgggagcttatcccgctttgccatccgttgttactttccaaagtggaagtaaatttagaaccgttacttgaaaccaatcaagttcgtattcaatctctttgcaaattaactggaaaaactggcgtagaaatggaagcactaactgccgcaagcgtagcagccttaaccatttacgatatgtgtaaagctgtgcagaaagacattgtgattgagcaagttcgcctgttagaaaagtgcggtggaaaatcaggccattttattgcggaggaaaaataa

SEQ ID NO: 2525 - DNA, 1014 bp, H. influenzae strain 86-028NP
atgcaatccattcctatcaagaacgtaggagagtctcgcttagtcgatcctttccaacgtcaatattactatctacgactgtcgattactgatcagtgtaattttcgttgtacctattgtttacctgatggttatcaacccgaagctaacaaaccaagtttcttaaccttaaaagaaattatccatcttgctcaagcgtttgctgaaatgggcacagagaaaatccgtttaacgggtggcgaaccgactttacgcaaagattttatttctattgccgaaagcattgctaacattgatggcattcgtcaattagccgtcacgacaaacggctatcgcatggcaaaagatgtggctgattggaagcaagcagggattacgtctattaacgttagtgttgatagccttgatccgaaaatgttccatcaaattacaggtatcaataaatttgatgacgtgatgcgtggtatcgatcgtgcatttgaagtgggttacaataaagtcaaagttaattcagttttaatgaaaaatctgaatgacaaagagtttgagcaattccttgcttgggtaaaacatcgcccaattcaaatgcgctttattgagttgatgcaaacgggcgaaatggatagtttctttgatagataccatctttctggacaaatcttagcggataaattgctgaaaaatggttggacattacagcataaatcccacacggatggccctgctaaagtctttacacatcctgattatgcgggcgaaattggtttaattatgccttatgaaaagaatttttgcgcaagttgcaatcgtttaagagtgtcagcgaagggcaaacttcatctttgtttattcggcgaagaaggcattgaattacgtgatttattgcagtcacacgaacagcaagctattttacaagcacgtatttttgccgcactgcaaggcaaacgtgaacatcattatttgcatatcggcgatactggtgtaagaaatcatttagcttctattggtggataa

SEQ ID NO: 2526 - DNA, 474 bp, H. influenzae strain 86-028NP
atgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaaataaagcagaaaataatgataaagattggacttcggcatcttatgcggagatgatcgatcacattattactcgttttcataatcgccaccgtgaacaactccctgaattaattacattggcggagaaagtagaaaatgtacatagtgatcgtgatgactgtcctatcggcgtaaccgcacagttagaaaaaatttatgctgaacttagccagcatttaatgaaagaagaacaaattttgttcccaatgatcaaaatgggaattatgctatggcctcaatgccaattcgtgtaa

SEQ ID NO: 2527 - DNA, 198 bp, H. influenzae strain 86-028NP
atggaaatggaacacgatgaagcgggacaagatgtggaagtgatcaaatcacttactaacaattgcacgccacctgcagatgcttgtttcagttggaaagctttatatagcggtattaatgaatttattgatgatttaatgcaccatattcatttggaaaataatattttatttccacgtgtattaaacgaaaaataa

SEQ ID NO: 2528 - DNA, 1014 bp, H. influenzae strain 86-028NP
atgcctaatttttcattcgtatttttttatgattccgctaaaataacgccaatttcaaccgcacttttaggaagaaaaatgaactatctaaaaattgcacaggattccctttcagtggaaagtaacgcacttttgcaactcagccagcgtttaggcgaggattttaatcaagtcatcgatcttattttagcctgcgaaggacgtttggtaatcggagggataggaaaatcgggtttaatcggcaaaaaaatggtggctacctttgcctctacgggtacaccaagtttctttttacatcctacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtgtgtccaaataatctcgcgccaacaacatccgcacttgtcacactggcacttggtgatgcactcgccgtatcgcttattacggcacgcaatttccaaccagctgactttgctaaattccatccaggtggcagtcttggtcgtcgtttattatgtaaagtgaaagatcaaatgcaaactcgcctaccaaccattttacccaataccaattttacagattgtctgaccgtgatgaatgaagggcgaatgggcgttgccttagtgatggaaaatgaacaacttaaaggcattatcactgatggcgatattcgccgcgcgcttacagccaatggtgcagaaacactgaataaaacagccaaagactttatgacaagttcaccaaaaactattcatcaagacgaatttttatcaaaagcagaagactttatgaaagcgaaaaaaattcactcgctagtggttgttaatgatgaaaatcacgtggtgggtttagtggaattttcaagctaa

SEQ ID NO: 2529 - DNA, 543 bp, H. influenzae strain 86-028NP
atgcaacaaaaattagaaaatattaaatttgtcattactgatgtagatggcgtgctcaccgatggacaacttcattatgacgccaatggcgaagccatcaaaagttttcacgtgcgcgatggtttaggcataaaaatgctgatggatgcaggtattcaagtggcagtgctttctggtcgcgactcccctattttacgtcgtcgcattgccgatcttggtattaaattattctttcttggcaaacttgaaaaagaaaccgcttgttttgatcttatgaaacaagcaggcgtcactgccgatcagaccgcttatattggcgatgatagtgtagatctccccgcctttgctgtttgtggtgcttcttttgcagtggctgatgcccctatttatgtgaaaaatactgttgatcatgtactttccaccaatggcggcaaaggggctttccgtgaaatgtccgatatgattttacaagcgcagggaaaatcctctgtgtttgataccgcccaaggtttcctaaaatcagtgaaaaatatggggcaataa

SEQ ID NO: 2530 - DNA, 4479 bp, H. influenzae strain 86-028NP; identical to SEQ ID NO: 671

SEQ ID NO: 2531 - DNA, 1638 bp, H. influenzae strain 86-028NP
atgaaaaatataaaaagcagattaaaactcagtgcaatatcagtattgcttggcttggcttcttcatcgttgtatgcagaagaagcgtttttagtaaaaggttttcagctatctggcgcacttgaaactttaagtgaagacgcccaattatctgtagcaaaatctttatccaaataccaaggtacgcaaactttaacaaacctaaaaacagcacagcttgaattacaggctgtgctagataaaattgagccaaataaatttgatgtgatattgccacaacaaaccattacggatggcaatatcatgtttgagctagtctcgaaatcagccgcagaaagccaagttttttataaggcgagccagggttatagtgaagaaaatatcgctcgtagcctgccatctttgaaacaaggaaaagtgtatgaagatggtcgtcagtggttcgatttgcgtgaatttaatatggcgaaagagaacccgcttaaggttacccgtgtacattacgaactaaaccctaaaaacaaaacctccaatttgataattgcgggcttctcgccttttggtaaaacgcgtagctttatttcttatgataatttcggtgcaagggagtttaactatcaacgtgtaagtttaggttttgttaatgccaatttaactggacatgatgatgtgttaaacctaaacgcattaaccaatgtgaaagcaccttcaaaatcttatgcggtaggcgtgggatatacttatccgttttatagtaaacaccaatccttaagcctttataccagcatgagttatgctgattctaatgatatcgacggcttaccaagtgcgattaatcgtaaattatcaaaaggtcaatctatctctgcgaatctgaaatggagttattatctcccgacatttaaccttggtatggaagaccagtttaaaattaatttaggctacaactaccgccatattaatcaaacatccgagttaaacaccctgggtgcaacgaagaaaaaatttgcagtatcaggcgtaagtgcaggcattgatggacatatccaatttacccctaaaacaatctttaatattgatttaactcatcattattacgcgagtaaattaccaggctcttttggaatggagcgcattggcgaaacatttaatcgcagctatcacattagcacagccagtttagggttgagtcaagagtttgctcaaggttggcattttagcagtcaattatcgggtcagtttactctacaagatataagtagcatagatttattctctgtaacaggtacttatggcgtcagaggctttaaatacggcggtgcaagtggtgagcgcggtcttgtatggcgtaatgaattaagtatgccaaaatacacccgctttcaaatcagcccttatgcgttttatgatgcaggtcagttccgttataatagcgaaaatgctaaaatttacggtgaagatatgcacacagtatcctctgcggggttaggcattaaaacctctcctacacaaaacttaagcctagatgcttttgttgctcgtcgctttgcaaatgccaatagtgacaatttgaatggcaacaaaaaacgcacaagctcacctacaaccttctggggtagattaacattcagtttctaa

SEQ ID NO: 2532 - DNA, 1953 bp, H. influenzae strain 86-028NP
atgacaaaagaaaatttgcaaaacactccacaaaatacgaccgtttcacttgtggaatcaaacaacaaccaaacttccccgcaaatgcttcaacaatcacccaaacctagcctattgcgcttggaacaacatatcgaaaaaaaagattatgagtttgcttgtcgtgaattaatggtgattctggaaaaaatggatgctaattttggaggcgttcacgatattgaatttgacgcacccgctcagctagcatatctacccgaaaaattactcatttattttgccactcgtctcgctaatgcaattacaacactcttttccgaccccgaattggcaatttctgaagaaggggcgttaaagatgattagcctgcaacgctggttgacgctgatttttgcctcttccccctacgttaacgcagaccatattctcaataaatataatatcaacccagattccgaaggtggctttcatttagcaacagacaactcttctattgctaaattctgtattttttacttacccgaatccaatgtcaatatgagtttagatgcgttatgggcagggaatcaacaactttgtgcttcattgtgttttgcgttgcaatcttcacgttttattggtaccgcatctgcgtttcataaaagagcggtagttttacagtggtttcctaaaaaactcgccgaaattgctaatttagatgaattgcctgcaaatatccttcatgatgtatatatgcactgcagttatgatttagcaaaaaacaagcacgatgttaagcgtccattaaacgaacttgtccgcaagcatatcctcacgcaaggatggcaagaccgctacctttacaccttaggtaaaaaggacggtaagcctgtgatgatggtactgcttgaacattttaattcgggacattcgatttatcgcacgcattcaacttcaatgattgctgctcgagaaaaattctatttagtcggcttaggccatgagggcgttgataaaataggtcgagaagtgtttgacgagttctttgaaatcagtagcaataatataatggagagactgttttttatccgtaaacagtgcgaaaccttccaacccgcagtgttctatatgccaagcattggcatggatattaccacgatttttgtgagcaacactcggcttgcccctattcaagctgtagccctgggtcatcctgccactacgcattctgaatttattgattatgtcatcgtagaagatgattatgtgggcagtgaagattgtttcagcgaaacccttttacgcttacccaaagatgccctaccttatgtaccttctgcactcgccccacaaaaagtggattatgtactaagagaaaaccctgaagtagtcaatatcggtattgccgctaccacaatgaaattaaaccctgaatttttggtaacattgcaagaaatcagagataaagctaaagtcaaaatgcattttcatttcgcacttggacaatcaacaggcttgacacacccttatgtcaaatggtttattgaaagctatttaggtgacgatgccactgcacatccccacgcaccttatcacgattatctggcaatattgcgtgattgcgatatgctactaaatccgtttcctttcggtaatacaaacggcataattgatatggttacattaggtttagttggtgtatgcaaaacgggggatgaagtacatgaacatattgatgaaggtctgtttaaacgcttaggactaccagaatggctgatagccgatactcgcgaaacatacattgaatgtgctttacgtttggctgaaaaccaccaagaacgtcttgaactccgtcgttacatcatagaaaacaacggcttacaaaagctttttacaggcgaccctcgtccattgggcaaaatactgcttaagaaaacaaatgaatggaagcggaagcacttgagtaaaaaataa

SEQ ID NO: 2533 - DNA, 2157 bp, H. influenzae strain 86-028NP
atgaatattcggttaaatgctaaagtaatttctacaattcctgtttttattgccgtaaatattgcggcagtgggaatatggttttttgatatttcttcgcaatcaatgcctttgattctagggattattgcaggtggtttggtggatttggataaccgtttaactggacgattgaaaaacgtattttttacccttattgccttttctatttcttcctttattgtgcagttacatattggcaagcctatccaatatattgtgttaatgacggtgctgacatttattttcactatgattggtgccgtggggcagcgttatagcaccattgctttcggttcattagtggttgcgctttacaccacattaacttatataccagaggtaaatgtatggtttattaaccctgtaatgattttatgcggtaccttgctgtatagcgtggtgactctgattgtttacctgtttttcccaaatcgccccgtgcaagaaagtgtcgctaaagcgttttgtgcgttgggcgaatatttagatactaaatcctgtttttttgatcctgacgaagtggctgagattgaaaaaaaacacctcaattttgcgatgaaaaatgcgaatgttgtcacggcatttaatattgtgcgtaccgcacttttttaccgtattagagggcaacatcgccatcctcgtacccagagaatgttacgttattattttgctgcgcaagatattcacgaacgcgccaattctacgcattttgattatcaacaaataacggaaaaactaaaaaatacagatttgattttccgtattcaacgtttgttagaactacaagcacaatcctgtaaagaaatcacggcgagtttgcgtgaaaataaaccttatcattttaatgaacgtgtcgaacgtgcgcttttaggcaccttgcattcctttgaactgtatcgaacacaacatctcaatgatcaagatgaactgattgatattcaaaccttgttagataatttacaaagcattaactggcaacttcgccagttagcacaagaaacgacggatacagaacaattagctcaaattcatacggaacaaatcactgggttaaaaaatataagtgcggtgatttttagccattttacgtttgagtcaccgttgttccgacatgcggtacgcttatctattgtggtatttctgtgctgtgcaattgttgagtttttccaatttaatcttggttattggattttattgaccactgtatttgtgtgccagccaaactattctgcaactaaagtacgtttacgtcagcgtattattggcacgatattaggcgtagtggtagggtctctattaccttatttaaatccaaccttagaattaaaacagggtcttgtggtgctcacaagtactttgttctttttcttccgtagtaataattatagtttctcgacctttttcatcacactacaagtattgctcagttttgatgtcatgggatttgatacggcagctgcgttgatgcctcgtttacttgatactttacttggtgccgcgatttcatggtttgccgtatcttacttatggccagattggaaatatttgcaacttgataaagtgagccatcaagcattgcgtagtgatgcggtgtatttattgcatattattagtcaattgcaatttggtaaaagcgacgatcttaaatatcgcatagcacgtcgcaatgcacatcaatatgcagccgcactgagtacaacactttccaatatgaataatgaaccagtgaaatacaaggcatatttacaaaaaggttttgatttactcaaactgaattattctctattaagctatatttcagcactgggagcttatcgagacagaatgaaaaatttgcaacagaccgcacagtttttatctggtttttatcctgtggcaaagaaaattatttataccttagaacacattgaagaaatacccgaagctatttttaaccaacagcaagaaagtatcgaaacacatttaaaagaattggaaaaacaagacatgactgccgaagaacgcgccgtctttagtttaccgtatcagcaattaaatttgattacccaactattgccacaattttatgggtattttaagaaagagataaactgtgagcgcgcgggagcgttataa

SEQ ID NO: 2534 - DNA, 666 bp, H. influenzae strain 86-028NP
atgaaattacgcgctgttgtattaggtcttgccacattatgcacaagtacggcaacctttgctggaatggtttccacttcatctaaccttgagtttttagcgattgatggtcaaaaagcctctaaatctctcggaaaagctaagacatttactgtagatgatacccaaagccatcaggttgttgtgcgtttaaatgaaattgttggttcaggatcgaatcaatctctttttgaatctaatcctgtgattgtgacatttcaaggtaatgctgaagatttagttatttccgcaccagctattcgtaatcttgatagtggcgataaattcaatcaaatgccaaatattactgtgaaaacaaaatcaggtaatgctatttcagcgaaagtggatgtgttaaaacaagaaggtttattcccaagtggtaatgtgctaaatgatcttgctgaatataatgcgtctggtgcagcggcatcagtttctaaatttactgcaacaacttctgctaattcaatggttgctgtgccagcaggtaatgcaaaagcgaataaaggcaaagtggttgttcagggcgaaaacgttgcagagcaacaacttcaatattggttccaacaagcggataaagaaactcaaacacgttttttaaactgggcaaaatcccataaataa

SEQ ID NO: 2535 - DNA, 1062 bp, H. influenzae strain 86-028NP
atgttgaacgatattttaacaggctatggaatttttattctggaaattttaacaattttattactcattcttgctattgttggtttgattatttcttatcgccaacataacaagtctaaagtgggagaattagaaattaaagatttatcagaagaatttaatgaacaagttcgtttattacgtgattttaatctttctgaagaagaacaaaaacaacgcactaaagctgaaaaaaaagcagaaaaacaaaatgctaaaaaacgcaaagaaaaattgaaaaaaggcgatactttagaagatgaaaagaaagcttgcgtatatgtattagatttttgcggcgatatttcagcctcagaaacaaccgcacttcgtgaagaaatttcagcaattttaaatgtagcaaaaccagaagacgaagtattactacgtttagaaagcccaggcggtattgtgcataattatggatttgcagcctctcaattgtctcgcttaaaacaaaaaggcataaaattaactgttgccgtcgataaagtggctgcaagtggcggttatatgatggcttgcgttgccgataaaattgtatccgcaccttttgctgttattggttctattggcgttgtcgctcaaattccaaatgttcatcgactattgaaaaaacacgatgtcgatgtagatgtaatgactgcgggcgaatttaaacgtacagtgaccgtattgggtgagaacactgaaaaaggcaaacaaaaatttcaacaagaattggaagaaacacataaattattcaaacaatttgtctcacaaaatcgcccttgcctagatattgataaaatcgcaacaggcgaacattggtttggacaacaagccattgcattacaacttgtagatgaaatctcaacgagtgatgatttaattttggaaaaaatgaaagaaaaacaggtacttaatgttaaataccgtttaaaaaaatccctaataaaaaaattcggacgacaagctgaagaaagtgcaattaatatcattcatcgttatagtacaaaacagtctagagactttatgtactaa

SEQ ID NO: 2536 - DNA, 579 bp, H. influenzae strain 86-028NP
atgacgcactatattttattgattatcggcaccgcattaattaacaattttgtattggtaaaattcttaggactttgcccttttatgggtgtatccaaaaaaattgaaaccgctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacagagtctgtcgtttatggttttggtgcatctctcggtttttccttagtattggtactttttgccgcacttcgtgaacgtttagtcgccgctgatatacctgccacttttcgcggttcagccattgctttaattaccgcaggcttaatgtccctcgcttttatgggatttacaggacttgtaaaataa

SEQ ID NO: 2537 - DNA, 582 bp, H. influenzae strain 86-028NP
atgacctttttattcatcgtaattacgctactcgctttaattttcggtgcgattttgggctttgcatcaatcaagctcaaagtggaagctgatcctgtcgtagagaaaattgatgctattttaccgcaaagccaatgtgggcaatgtggttatcctggttgtaagccttatgctgaagccatttgcaatggcgatgaaatcacaaaatgtattccaggtggtcaaacaactatcgtaaaaattgccgaaattttaggggttgatgtaccaacaatggagggcatagaagaacctatcgagaaagttgcttttattgatgaaaatatgtgtatcggctgcacaaaatgtatccaagcctgtcccgttgatgccattattggtacaaataaagcaatgcacacgatcattcccgatctttgtacaggttgcgagctttgtgttgcgccctgcccgacagattgtattttaatgattcccgtgaaaaaaaatattgataattgggattggaaatttgatgcaaaactcgttattccagtaatgaatgtcgatggctctgaaaaaaaattggttgtgggggaataa

SEQ ID NO: 2538 - DNA, 1998 bp, H. influenzae strain 86-028NP
atggcggacgtattatctcgtttcaattccggtaaattatgggatttcaaaggtggcattcatccaccagaaatgaaatctcaatctaattcacagccattacgccatctgcctctcggcacggatttttacattccactcaaacagcacctaggaacaacaggcaatcttttaataaaagagggcgattatgtcttaaaaggacaagccttaacaaaaggcgatggcttgcgtatgttgccagttcacgcgcccacttctggcacaattaaatcgattaaaccttatgttgccacgcatccttcaggtcttgatgaacccacaattcatttacaggcggatggtttagatcaatggatcgaacgtaatcctattgatgatttttcaacgctatcgccagaacaacttattcacaaaatctatcaagcaggtatagcaggtttaggcggtgcagtattcccaactgctgccaaaattcagtcagcagagcaaaaagtcaaactcttaattatcaatggtgcagaatgtgagccttatatcacttgtgatgatcgtcttatgcgtgaacgcgctgatgaaatcataaaaggcattcgtattttacgttatatattgcaccctgaaaaagttgtcattgccattgaagataacaaaccagaagccatatcggcaatccgcacagcactacagggagcaaatgatattagcattcgggttattccaacaaaatatccttcaggtgctaccaaacaactgatttatttgctcacagggatagaagtgccaagcggtgcacgttcatccagcattggcgtattaatgcaaaatgtgggaacaatgttcgcaataaaaagagcaattataaatgacgagcctttaattgagcgtgttgtcacccttactggaaataaaatcgctgaaaaaggcaattattgggtgcgtcttggcacacccatttcccaaatattgagcgatgcaggctatcaatttgacaagcattttcctatatttgcaggtgggccaatgatggggctagagcttccaaacctaaatgcacctgtgacaaaacttgtcaattgtttacttgcgccagattatcttgaatatgccgaacctgaagcagaacaggcttgtattcgttgttctagctgttctgatgcctgcccagtaaatttaatgccacaacaactttattggtttgcgcgcagtgaagatcacaaaaaatcggaagaatacgctctcaaagattgtattgaatgtggaatttgcgcatacgtatgcccaagccatattcctctaattcaatatttccgccaagaaaaagctaaaatctggcaaataaaagaaaaacaaaagaaatcagatgaagccaaaattcgctttgaagcaaaacaagcacggatggaacgtgaagaacaagagcgtaaagcacgttcacaacgtgcagcacaggctcgccgtgaagaattagcacaaactaaaggggaagatccagtcaaggcggcactcgaacgcttgaaagcgaaaaaagccaatgaaacagaaccaacgcagattaaaacactaacctcagaaaaaggagaagttttacctgataacacagatttaatggcacaacgtaaggcacgccgtttagctcgtcagcaagcagcatctcaagtcgaaaaccaagaacaacaaactcaaccaaccgatgcgaaaaaagcagcagtagccgccgccattgctcgagcaaaggcaaaaaaacttgcacaaacaaatagcaccagcgaagccatttcaaactctcaaaccgcagaaaatgaagtagaaaaaacaaaaagtgcggtagaaaaaacagaagaaaattcaactgcacttgaccctaaaaaagcagccgtagccgccgccattgcgcgcgcaaaagcaaaaaaacttgcgcaagcaaatagcaccagcgaagctatttcaaactctcaaaccgcagaaaatgaagtagaaaaacaaatagtgcggtag

SEQ ID NO: 2539 - DNA, 1077 bp, H. influenzae strain 86-028NP
atgtttaaaatggttagctccccacatacccattcgggaaaactcacagcgcatattatgctttgggtcattttggcaatgatgcccgcttttttcacgcaaatttattattttggatttggcgtggtgcttcaatccgcattagccattggtacggcaatcattgctgaatttattgcaataaaattacgaggtaaaaaaccgctcaattatctttcagatttcagcgtagccctaactgcgttaattttggcaatggctattccaccttatgcaccttattggattatcatcattggaacactctgtgcagttttattaggtaaacaggtttatggggggttagggcaaaacccattcaatcccgcgatgattggctatgtaattcttctaatttcattcccattacaaatgacaacttggatgccaccaattaatttattacaggaaccaccgactttttcagatactttttcattaatattttcaggtttaaccacggatggatttaccctttcacaacttacacataacattgatggcatcacccaagcaacgcctttggatagcgcaaaaattttctataaaagtcacaatcaattaagtgatttttatgaattaattaaactgccgatttttatgggtaatggaaccgattttgctcaaggctggtggcaaatcaacgtggctttcttagcgggcggaattttccttattttaaaacgcattattcactggcaaattccagtggcgatgcttgtcacctttttctgtttagccactgcgaccgcttttactggtttcacgcatttaagtgcgattagccaactcgttagtggcgcaatgatgtttggtgcattttttattgcaacagatcctgtcacagcctccattacaccacgcggaaaaattatttttggcgcattagtggggttatttgtttatctcattcgttatcacggaaattatccagacggcgtggcattcgccattttattaagtaatatttgcgtcccacttatcgatcattacacacgtccgcgcgtatctggttatccaacaaaaggaagaaaataa

SEQ ID NO: 2540 - DNA, 624 bp, H. influenzae strain 86-028NP
atgggtacagtaaaaatcacatcgcgttatggcatattgttaggctttattgccctactttgcacaataatttctacaggaattttcttcctaacaaaagataaaattgatgcggtaatcgcagcacaacagcgagaattacttctacaagttatcccacaagattatttcaacaataatttgctagaaagtgcggttattcctcaagataaaaattttgtgggtatccaaaaaatttattttgcgaaaaaagatggaaatatttctgcctatgcctatgaaaccaccgcgcctgatggctattctggcgatattcgcttgcttgtgggattagatccgaaaggcgaagtgttaggcgtacgagtaatcgaacatcacgaaacaccaggcttaggcgataaaattgaacgccgaatttctaactggattttaggtttcacaaatcaatcgattaatgaacataatttaagcgaatgggcggtaaaaaaagatggcggaaaatttgatcaattttctggtgcaaccattacacctcgcgcagtggttaatcaaactaaacgctcagcattaatcatgctaaataatcaagccttgttacaacagctttcaacacaagtgaaataa

SEQ ID NO: 2541 - DNA, 708 bp, H. influenzae strain 86-028NP
atgacagatttaactgaaaaaaataccgcacttgaagaagaaaaaatagaaagtgcggttgaaaatcaacaaaaatccatctggaaagaaatttttgctcaaggaatttggaaaaataaccctgcggttgtccaacttctcgggctttgtccacttttagcggtgtctagcacagccaccaacgcgcttggtttgggtttagcaacaatgcttgtactcacttgcacaaatacggtcatttcccttttccgtcaatatattcctaaggaaatccgtattccaatctacgtgatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccattctcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatgtaaaaaaataa

SEQ ID NO: 2542 - DNA, 636 bp, H. influenzae strain 86-028NP
atgaacaaaacaaaaagaatcgaaatactcacaagattacgagagcaaaccccccacccgaccacagaattacagtataattcgccctttgaattattaattgcggtcattctatcggcacaagcaaccgataaaggcgtgaataaagcaacagaaaaactattccccgtggcaaacacgcctcaagcgattttagatttaggattagatggtttaaaaagctatattaaaactatcggtctttttaatagcaaagcagaaaatattatcaaaacttgccgtgatttaattgaaaagcacaacggtgaagtgcccgaaaatcgcgaagccttagaagcattagctggtgtgggtagaaaaacagccaatgttgtgctaaatacggcatttggtcatccaactattgcggtagatacccatattttccgtgtatgcaatcgcactaattttgcagcgggtaaagatgtggtaaaagtggaagaaaagctgcttaaagtcgtgcctgatgaatttaaagtggatgttcatcattggttaattttacacggtcgatacacttgtatcgcgcgtaaaccacgttgcggatcttgcattatcgaagatctttgtgaatataaagaaaaagttgaattttaa

SEQ ID NO: 2543 - DNA, 1374 bp, H. influenzae strain 86-028NP
atgacaacaaacaataaacagcgacaaacttggtcgagccgcctcacttatgtaatgacggtcgcaggcgcaacggtcggtttcggtgcaacttggcgtttcccttatcttgtgggtgaaaatggtggcggtgcttacgttctacttttctgtatcgcaatgattgtaatcggtatcccaatgattttagttgaaaacgtgataggtcgccgtttacgtgtaaattccattgatgcgttcggcgataaaattctcgacaaaggaaaaggcatttctaaatattggaaaatattaggttatatgggcttactcggcgcatttggcattatggcgtattatatggtgcttggtggttgggttatttcttatatcattagcctaatcagcggtacattagacatttcaacccccatcacaaaagacattgccaaaaatttctacgatcttcatatcggcaatagcccttatgaaattatattctacaccctcttatttgttatcgtgaattacattatcttggcaaaaggtatcattggtggaattgaacgttcagtaaaatatttaatgccattactatttatcttcttaattggaatggtaattcgcaacgtaacattaccgggcgcaatggaaggcattacattctatttaaaacctgatttcagcaaaattaccccacaattatttatcttcgttttagggcaagtcttcttcgcattaagccttggttttggtgtattaattaccctttccagttacttaaataaagaagaaaacttaatccatactgcagttattacaggtttcaccaatacaattattgctgtacttgctggctttatgattttcccctcacttttcacttttgggattgaaccaaacgcagggccaactttagtattccaaagtttacctatcgtattttctcacttatgggcaggtaaattctttgcgattatcttcttcggcttattattaattgctgcgctgactacttccatcacaatttatgaagtaatcattacagcattacaagaaaagctcagaatgcgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgctcttggctgtgctattttcgttggtttcgtgttaaaagatgaagccaaaaaagaactttcttcaacaaaatattcaactttcatcaaaatttggtttaactacgtgaaatttgttgtacccttgatcatcttagttatctttatcagcaacctgttctaa

SEQ ID NO: 2544 - DNA, 1056 bp, H. influenzae strain 86-028NP
atgttgcaaattaatgtgaaaaaacagctcgggaaacttgccttgcaagcgaatatacaagtgccagatcaaggcgtaaccgccattttcggtttgtctggctcaggcaaaacatcgctgattaatctagtcagtggattgatacaaccagatgaaggattcatccgtttaaatgaccgcactttagtggatatggaaagccaagaatcattgccgacccacttgcgtaaaattggctatgtattccaagatgcgcgtttatttcctcactacactgtgaaaggtaatttgcgctatggcatgaaacatgtctcgcaagatgattttaactatattgtcgatcttctcggtattactcatttattaaagcgttatccgcttacgctttctggcggagagaaacaacgtgtggcaatagggcgtgcgctgctgactgatcctgatattttactgatggacgaaccactttctgcccttgatgttccccgcaaacgcgagctaatgcaatatttggaacgtctttctaaagaaattaatatcccgattttatatgttacacatagcttggacgaactgttgcgtttagctgatcgggtcgtattgatggaaaacggcattgtgcaagcctatgacagcgtagaaaaaatttggaatagccctatttttgccccttggaaaggggaaaacgaacagagcagtgtacttgccttgcctgttcatttgcataatccaccttataaaatgaccgcactttcgctaggcgaacaagcactttggattcatcaagtacccgcgaatgtaggcgagcgagtgctagtttgtatttatagttcagatgtttctatcatactgcaaaagccagaacaaacaagcattcgtaatattttacgtggcaagattacacaaattgagatacaagattctcgagtggatcttgccgtattagtggaagggaataagatttgggcaagtatcagtaaatgggcgcaaaatgaactacgttttgctgttgggcaagatgtctatgttcaaattaaagcggtgtcggtgatgtag

SEQ ID NO: 2545 - DNA, 690 bp, H. influenzae strain 86-028NP
atggaaatctcagcaattaatttaagcctgagtgttgcagtcagttctatgctttggagtttgccgttagccatttttgtggcgtggctcttagcgcgcaaaaacttctatggcaaatctctgattactggcgtaattcatttgcctttagtgttgccaccagtggttatcggttatctattacttgtagcaatggggcgcaatggtttcattggcaagtatttatatcagtggtttggcttatcttttggttttagttggaaaggtgcggtgctttcctctgccgtggtggcctttccattggttgttcgcgcgattcgactttctttagaaaatattgatattaaattggagcaagcggcgcaaacactcggtgcttccgcttggcgtgtattttttacaataaccttgccgctttctttacctggggttttagctggactcgtgcttggttttgcacgatcattaggggaatttggcgcgaccattacctttgtatcgaacattgcaggcgaaactcaaacgattccccttgcgatgtattcttttattcaaacacccgcagcagaagaacaaactgctcgcttatgtttatttgctatcattctttcattgatttctttgttactgtctgaatggttgagcaagcgaatgcagaaaaaattaggacaaggaaatgttgcaaattaa

SEQ ID NO: 2546 - DNA, 765 bp, H. influenzae strain 86-028NP
atgaaaaaattaactaaaatttcaaccgcacttttaatcgcgggattaggcttttcttttgcggcatccgctaaagtgactgtatttgcagccgcttcaatgacagatgctttacaacaagttgcaaaagattacgcaaaacaaaatccgaaaaatgaagtagtgttttctttcgcttcttcttcaactttagcaaaacaagttgaagaaggcgcgccagcggatatttttgtatctgcaagcaataaatggatgaaatatctttctgaaaaagatttaaccgtaaaagaaacagaaaaagttttagtgggcaatgatttagtcttaatcgcaccagcaaaaagtgcggtaaattctgtggatattgcaaaaggtgaatggatcaatgcattaaaagatagctatttatctgttggcgatcctgcacacgtacctgctggtcaatacgcagcagaagcattaaccaaattaaatttatgggataaagtgcaagatcgtttagcgcgtgctaaagatgtgcgtggcgcattagctttagttgaacgtgcagaagcaccttacggtattgtgtacagcactgatgcaaaagttagccaacaagttaaaacggttgcagtgttccctgcagatagccataaaccagttgtttatcccgtttctattgtaaaaggtcatgataatgcggattctcgcgatttcttgaaatatttagaatcagatgctgcgaagaaagtgcttgtagggtatggtttctctgcaaaataa

SEQ ID NO: 2547 - DNA, 768 bp, H. influenzae strain 86-028NP
atgaaaaacaccgaaattttactcacgattaaacttcaacaagcactttttatcgatccaaaacgagttcgtttactcaaagaaattcaacaatgcggttcgattaatcaagcagcgaaaaatgcaaaagtgagctataaaagtgcgtgggatcatttagaagccatgaataaaatcagccctcgcccattgctggaacgaaatacaggtggaaaaaatggcggaggcacggtgcttaccacttatgccgagcgtttgctccagctttatgatttattagaacgtacgcaagaacacgcgtttcatattctacaagatgaatccgtaccgttagatagtttactcacggcaaccgcacgtttttctttacaaagtagcgcacgcaatcaattttttgggcgagtggcacaacaacgaatcattgactctcgttgcgttgtggatgtgaatgtgcaaggattaccaacgccgttgcaagtttctattaccacaaaaagctcggctcgtttgaaactgattacggaaaaagaagtgatgctgatgttcaaggcaccttgggtaaaaatcagtgaacaaccattagtaaatcaaccgaatcagttctctgtaaatatcaaatcactcaatgaagaggaagccatccttcaatttgctgaaagcaacattgaattttgtgccacggtccaccagccaaatcaatggcaaatcgggcaacaggtttggattcacattgatcaagagcaaattatattagcgacgctgggataa

SEQ ID NO: 2548 - DNA, 804 bp, H. influenzae strain 86-028NP
atgaaattttcagtcctaatgtccttatatattaaggaaaatcctcaattcttgcgggagtgttttgaaagtcttgttgcacaaactcgtcaagcagatgaaattgtattggtttttgatggcgtagtaacgccagaattagaatctgttgtgacagaatttgaaacaaaattgccattaaaattagtcaaattgccgcaaaatcgaggattaggcaaagccttgaatgaaggtttattgcattgtacttatgactgggttttccgtatggataccgatgatatttgcgtgcctgatcgttttgaaaagcaagtagcgtttattgaacagcaccctgaaagcatcatttttggcggacaaattgctgaatttggtaaaaatgtaaatgatattgtggcatatcgtaatgtgccaacttctgctcaagaaattattaaattcacgcaaaaacgttgtccgtttaatcatatgacggtggcatatcaaaaaagtgcggtcattaattgtggtggatatgaagatcttcaagaagattattatttgtggatcaaacttgtcgcacaaggtttatatatggcgaatttgccagatattttagtttatgctcgagtaggaaatggcatggtaagccgccgtcgtggcgtcaatcaagctaaagcagaatggcgtttgttcaaattgaaataccgtttgggaattcagggtttgttatctggattatttacttttgcattgcgttttggttctcgtttattgccaacctcgttattgaaaaaactttatcaaacttttttacgtaaatag

SEQ ID NO: 2549 - DNA, 885 bp, H. influenzae strain 86-028NP
atgttaagcattattgtgccttcttataatcgaaaagcagaagtgccagctttattagaaagtttaactcaacaaacatcgagtaattttgaagtgattattgtggatgattgctccaaagagagagtagttgttgaacaaagttattcttttccagttacagtgattcgtaacgaaaccaatcaaggtgcagcggaaagtcgtaatgttggtgcgcgtacatcaaagggcgattggttgctttttctcgatgatgatgatcgttttatgccagaaaaatgtgaaaaaatactacaagtgattgagcaaaatccagacattaattttatttatcatcctgctaaatgtgaaatggtcaatgaagggtttacttatgtgactcaaccgattgaaccccaagaaatctcgacagaacgtattttgttagccaataagattggtggcatgccaatggttgcgattaaaaaagagatgtttttaaaaataggtggattatccaccgcacttcgttctttggaagactatgatttcttgttaaaactgttacaagagccaagttttactccttataaaattaatgaaccactaacttactgtactttccatactaaacgctcaagtgtgtctacggataccactaatacgcaaaaagccattgattatattcgcgagcattatgtgaaaacggtggagcaagctcgtaattttgatattaacgcgagctatattttggcttatccccatatcatgaatttatcgcgtaaagcggcaaaatattattttgatatttttaagaaaacaaaaagcattaggcaatttattattactttggttattttaatttcgccaaaattagccattaatttaaaacggttgggaaaataa

SEQ ID NO: 2550 - DNA, 774 bp, H. influenzae strain 86-028NP
atgttaaaaaaatatttgatctctttagataaagatattcaacgtcggaaattattcttttctcaaaaaaataccgaggatttccaaattttttctgccattaataccatgcaaaaagattgggatgaattagcctctatttttaatattgaacaatttaaagcacattattttcgtaatgtcactaagggcgagatcggttgtactttaagccacctttctgtgtaccaaaaaattattgaagacaacgatattgctgaagatagctatgcactagtctgtgaagacgatgctttattccactcagattttcagcaaaatttaaccgcacttttatcagaaaaacttgaggctgaaattatattgcttggacagtcaaaaattaataatttcaatgatactgatttagaaattaattatcccacaactttttcttttctatgcaaaaaaacaggcaatgtaaattacgctttcccttataaaagttattttgctggcacggtgggctatcttataaaaaaatcagccgcaagaagatttatccagcaaatttcccaaaataaaccattttggttagcggatgattttttactctttgaacagaattttaatataagaaataaagtggttcgccctctcatggtcattgaaaatcctgtattgataagcaatttagaaagtgttcgtggatctttatccaataatttacttaaaaaattaatgaaatatccattgaaaaaaatctttgcgattaagaaaaatttggctaattaa

SEQ ID NO: 2551 - DNA, 1062 bp, H. influenzae strain 86-028NP
atgaaaaaaattggtttctttattatgaatatcgaaagtgcgggtggaacggagcgagtttccattaatgttgttaatgctcttgctaaacagggatatgatgtttcttttattagcattggcggtaacaagccttttttccaagttgatgaaaaaattaatatttacccaatgaataaattgccatattcattgaaaaaagattatttttctatcactaaaaaattaagagaattagttaaagaattacagctggataccttaattgtggttgatggtgcaattatgcttttttctgctttggcgttggttaatttaaatataaaacatattttatgggagcattattcttttaattttacgggcaatcgtctcgttcgcacgctcggtaaatatttagctgtaacaacttgcgataaaatagttacattgacagaagcagaaaaaacgctgtggcaagaaaaatttaaaacgaacaatataatcagtattgctaatccaaatacgcttttgccaaagaataaattagcaaaatgggaaaataaaactgttttatctgtaggtcatttattttcttataaaggttttgattatttattaaaagtttggcaagttttggcaaaaaaatatccagattggaatttgaaaatagcgggttcaggcgaggaagaagaaaatttaaaaaatcttgctaaagcattgaatattgaagattcagttaattttattcctcgtactaatgatgttgctttttattatgaaagcagttcaatttattgtttaccttcacaaacagaagggttgcctttagtcgttattgaagcgatggcatttggcttacctattgttgcctttaattgttctcctggcgtaaagcaattagtcgaacataaagaaaatggttttctttgtgaacaaaataatattgaagaaatggttaaaggtttagatttattaatcaataatcctgaactttatcaacaaatgtcagacaaatctcgtttaatgagtgaagattatggcattgagaaaattattgaagaatggaaagggattttataa

SEQ ID NO: 2552 - DNA, 915 bp, H. influenzae strain 86-028NP
atgaatctcattctttgttgtacaccattgcaagtattaattgcgagaaaaataattgaattacatcctaatgaacaattctttggcgtaatgtttggtagggtatgggataaaaaaagaaccttgtatgcgagtaaattagcggaggtttgtagtgattcgatgaatattgatacgggaaaagatctaaaaggtttcgattttctcaagttaatgcgccagcttaagaataaaattacgcacaaaggttttgataaggtttttctcgccaatcttaattcattatggctacaaacttatcttagtcatgtttcatttaaagagctttatacctttgatgatggttcagataatattttcccacatcctaatttattgagagagcctgacacatttaaatataaactgattaaagcttttattggcgataaatatagtgtgaataaattatttaaaaaaataaaaaaacattatacggtttatcctaattacaaaaatattgtttctaatattgaaccaatttctttatgggataatcaaatagattgcgagatagatggtgaggtctcattttttattgggcaaccattgttaaatacaaaagaggaaaatatctcattaataaaaaaattaaaagaacaattttcttttgattattatttccctcatccagcagaagattatcgagttgatggggtaaattatgttgaatctgaattaatttttgaagattacgtatttaaatatttatcaaataaaataataattatttatacgttcttcagttctgttgcatttaatttgttaagtcatcctaatgtagaaattcgttttattagaacgagtattccaagatggcaattctgttacgattcatttccagaccttggattaaagatttataaggaaatttaa

SEQ ID NO: 2553 - DNA, 1206 bp, H. influenzae strain 86-028NP
atgaaagtttttaaagatagtgctatttaccttgttggggaattatcgtcaaagttagttccttttttacttttgccttatttatcccgtaaattgggcgtagaagggtatggctcactttcttattatcaaacttttttaagtttatttttaattgtggtttctttaactcaagaaggcgcaatttcccgttatttttatttttacggaaaacgttcattaaatttagtggtgaataccggctatgcttataccacgataatcggcagtattattttaatgggttgttggattgctcagtctgaaatattattttacgctgcactttcctcaattttccaatctttcttaaatgttcagctaagtgtaagacaatgccagaaaaaggcttggtcttatgcttttattcaattttcacttactgttacgggagctgtatttacggtcgcattgcttgagtattatcaaaataatcttgttgaaaaaagaattttggcaattttattgagtaatttagtcgtttggtttttttcttattttctttacagaaagagtacgacatctaaaaaatatcaatttaagcattatcaatccgcactattttatattttaggatttggattaccgcttattttacattatgcaagttttttcttaaaagggcagttagaccgtatttttatttatcacaaattcagtgaaacagatttagggctttatgctatgggggctcaacttgctttaattgtttctattgctattcaagcacttaataaagcgattattccctatttttatgaagccttaaaacaaaagaaattagttattcaacagctacataaatgggcgttattttcctttttgctaatacctattcctgccttaataatgtggattattcctgaggatgtgttagtttggattttaggtagtcaatttgtgggaacgaaatattattttattttatttttaatttcgaccacattaagtattccttatttgattttagttaattatcttttctattatgggaaaaataaacttatttcccaatgttccgttttatctacaatcatttatgtggcaagccttgtagctttaacttttacagaaattaaatatatcccttatgctggaattattggttcgctttccattattcctattctttattttatgacatctaaagtgagtaaaaccctatga

SEQ ID NO: 2554 - DNA, 744 bp, H. influenzae strain 86-028NP
atgttagaactcggaaaacttcttaccacacttatcgcaccacctcttaatacctttgtattactgattattgcagcgattatttattgtgttcatttcaaaaaattagccaaatttcttgcgattataagtttcacttggctttatatcatgagtgtgccttttactggtttattgctaacaaataatgatgattctccagcccttacgctagatgagtataaacaagctcaagccatcgtcatattaggcggtggatcttaccaaaccaaagagctgtatgcagaaacggcttctggtgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttagtgaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcgttaaatagcaatatggttttattaaaagagtggattggttattggaaagcccattatgtagaataa

SEQ ID NO: 2555 - DNA, 2270 bp, H. influenzae strain 86-028NP
atgacaacatcacatattttaggctttcctcgtgtaggggcaaaacgtgaattaaaatttgcacaagaacgttattggcgtaaagaattagcagagcaagatttattagatttagcgaaagcattgcgtgaaaaaactggaaacatcaagcggctgccaatgcggatttcgttgcagtgggcgatttcacgttctacgatcatattttagatttacaagtggcaacaggggcaattcctgctcgttttggttttgatagccaaaatttaacccttgatcaatatttccaacttgcacgtggtaacaaagatcaattcgcaattgaaatgaccaaatggtttgatacgaactatcactatcttgtgcctgagttccaaaaatcgaccgctttcaaagctaatccagcacattatgtaaaccaaatccgtgaagcaaaagccttaggcttaaacttcaaacctgtgattgttggcccattaacattcttatggttaggtaaagaaaaaggcgaagcatttaaccgtttcgatttattaaatcaattagtgcctgtttatgttgaaattttaaatgcattagtggctgaaggggcagaatggattcaaattgatgaacctgcattagcattagatttaccagcagaatgggttgaagcctataaatctgtttacgctgaattaagcaaagtgaacgcaaaattattattagccacttattttggttcagttgcagaacacgctgaattattaaaagccttacctgttgcaggcttgcatttagatttagttcgtgcaccagaacaacttgcggcatttgaagattacagcaaagtgttatcagctggtgtgattgaaggtcgtaatatctggcgtgcaaacttaaacaaagtgttagatgtattagagccattaaaagcaaaattaggtgagcgtttatggattgcaccaagctgttcattattgcataccccatttgatttagaagtggaagtacaattaaaagaaaaaaataccgcactttacagctggttatctttcacgctacaaaaagtagaagaattaaacgtattaaaacaagcgttaaataatggcagagcgtctgtacaagcagcattagatgcaagccaagcggcagcagatgcacgtgcaacctcaaaagaaattcatcgccctgaagtggcagaacgtttagcaaacttgccaaaaggtgcggatcaacgtaaatcgccatttgcagaacgtatcgttaagcaaaatgcgtggttaaatttaccgcttctgccaactacaaacattggttcattcccacaaactactgaaattcgtcacgcacgtgcaagtttcaaaaaaggcgagttatctcttgcagattacgaagcggcaatgaaaaaagagatcgaatatgtagtacgtcgccaagaagaattagatttagatgtgttagttcacggtgaagcagaacgtaacgacatggtggaatactttggggaattattagatggtttcgcattcactaaatttggttgggtacaaagctatggttcacgttgtgtaaaaccaccagtgatttacggtgatgtaactcgcccagagccaatgacagtacgctggtctcaatatgcacaaagcctcacaaaccgtgtaatgaaaggaatgctcacaggccctgtgactattttacaatggtcattcgtgcgtaacgatattccacgttcaaccgtatgtaaacaaatcggcgtagcattatctgatgaagtgttagatttagaagcagcaggcattaaagtcattcaaattgacgaaccagccattcgtgaaggtttaccgcttaaacgtgcagattgggacgcatacttacaatgggcaggcgaagcattccgtttaagctcaatgggcgtgcaagatgatacgcaaattcacactcacatgtgttattccgagtttaacgacatcttacctgccattgcggcattagatgcagacgtgattaccatcgaaacttcacgttcagatatggaattattaacggcatttgcagatttcaaatatccaaatgatattggcccaggtgtttacgatattcacagccctcgtgtaccaacggcggcggaagtggaacatttattacgtaaagcattaaatgtaattccaaaagaacgcttatgggtaaacccagactgcggtttaaaaacgcgtggctggacagaaaccatcgaccaattaaaagtgatggtggatgtaaccaaaaaattacgtgcggaattagcgtaa

SEQ ID NO: 2556 - DNA, 1077 bp, H. influenzae strain 86-028NP
atgataaatacccttgatcgttatattggaaaaagtattcttggcacgatttttgctactttaatgactttagtgggattgtcggcgattattaaatttgtcgaacaatttcgtagtgtaggtaaaggcacttatgatatttggcaagcggtaatttttactggtttaactataccgaaagatattgaaactttctttcctatggcagcattgcttggggcattaattgcactaggtaatcttgctagcagaagcgaacttgttattatgcaatcagctggattttctcgctttaaaataggtatagcggtaatgaaaactgcattaccattagtagtatttacaatgattattggggagtggggaattccacaaacagaacaatttgcacgagatatgcgcgctaaggctctttctggtggttcaatactttcaattaaaaatggtgtgtgggcgaaagatggtcatcattttgtatttgttaggcgtgtgacggatgatacaaaattagacgatatttatatttatacctttgatcaacagcataatttaataaaattaaaacatgcaaaccaggcgagttattctgaagatgaagctaaatggacattgcgtcaagttaatcattcaacgattatgaaagatgaaatcatcacaacgaatcatttatcagaaacttgggaaactagtttgacgccagataaattaggtgcggtttctttgcgtccgacatcattatctatctcaggtttatatcattacatttcatttctgcgtgaaacagggcaagatgtgagtcgttttgaactcacgttttggcgtaaaattttccagcctgtatccgttggcgtaatgatgttattagccttatcttttatttttggctcgctacgcagtgtgactgcaggtgcaaggatagttactgggatttgtgtaggattcttattttatgttgttaatgaaattttaggacaaacgagtgtagtttacggtattcctgctatttttggtgcattgatcccgagcttgcttttcattgtaatgatttggtggttattaagtcgtaagcgagattaa

SEQ ID NO: 2557 - DNA, 1104 bp, H. influenzae strain 86-028NP
atgattttaattcgatatttaataaaagaagttttcaaaagccaaatcgcaattttactaattttgctattgattttttttagtcagcagtttgtgcgtgtattaggtgcggcggcaaatgggaatgtgccagctgatttggttttctctttattaggcttaggaatgccgacaatggcgcagttgatgttgccactatgtttatttattgcgattttactgacttttggtcgcctttacgctgaaagtgaaatcacagtgatgcgcgcgtgcggtgtggggcaacggattttggttaaagtggcactgattatgtctttattaacggcaggtattgccgcttataacgcattatggctttcgccttgggcaattcaaaaacaagtgaatatggtggaagatgcaaaggctaatccaaccgttggcgtgctgtcttcaggtcagtttatttctaccaacaataataacgttgtgttatttattgataagattaaagataatcaaatccgcaatgtttatttatttcaaatgacacctcaaaaacaaacaaaaccttcagtgataacagctgaaaaaggggaattaattgcgttgccaaatggtgatcaagtcttaaatttgaaaaatacaaaacgggttgaaggaacctccgctttgccagattttcgcattacgcattttgatgaatatcacgcctatttaggttatcaatccgcagaaaataccaatgatgaagtagcagaattaacattgtctcaacttatcgatttagattcttcttctgcgaaagctgaattgcattggcgtattaccttaattttggcagtgccattaatggcattgattgctgtaccattaagtcgcgtaaatcctcgacaaggtagatttgccaaaattttacccgcacttttactctatttaatttatttcttgttacaaagctcttttaaatctgcaggttcagcgggaaaattagaggctgaacttttaatgccgcttgttaatatcggatttttcttacttgctgtggtgttgaatagctgggacagtgaaataatgtataaatttcgctatttattcagtaagaaaggatcggcaaaatga

SEQ ID NO: 2558 - DNA, 1476 bp, H. influenzae strain 86-028NP
atgaaatatcaagcaaaaaataccgcactttctcaagccactgattgcattgttttaggcatctatgaaaataataaattttcaaaaagttttaatgaaatcgatcaattaacccaaggttatttaaacgatttagtgaaatcaggtgagctcactggcaaattagcccaaaccattttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatctttaatacggattgtaatcaagcacaacaagctatttctcacgccaatgccattagctcaggcataaaagcagcacgtgacatcgcaaatatgccaccaaatatttgtaatccagcttatcttgctgagcaagcaaaaaatttagcagaaaattctaccgcactttcattgaaagttgtggatgaagaagaaatggctaaacttggaatgaacgcttatcttgccgtctcaaaaggctctgaaaaccgtgcttatatgtctgttttaacattcaataatgcgccagataaaaacgccaaacccattgtacttgtaggcaaaggattaacctttgatgctggcggtatttcacttaaacccgccgcagatatggatgaaatgaaatatgatatgtgcggtgcagcctctgtcttcggcacaatgaaagccattgcacagttgaacttaccattaaacgttattggtgttttagcaggttgtgaaaatctgccagatggcaatgcttatcgcccaggcgatattcttaccactatgaatggtttaactgtagaagttcttaatactgatgcagaaggtcgattagtgctttgtgatgcacttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctggggtggcgcaattacagcgggtgcatttttgtctaacttcacgaaaaaatatcgctgggcacatttagacatcgcaggcactgcttggttacaaggcgcaaataaaggtgcaacaggtcgccctgtttcgctattaacccaatttttgattaatcaagttaaataa

SEQ ID NO: 2559 - DNA, 2010 bp, H. influenzae strain 86-028NP
atgacaaagcgaacgtcatttaatcctttggtaattggcgttacgttattttttatattgttactgatggcaatgatttttattgcgccagagcaaactcaagcattattgaatcaagctaaaagtggtatttttgctaattttagttggttttatgtactcactttttcagtgtttttaggatttttattaattttatcagtaagtagtcttggcaatataaaactagggcaagatgaagaagaacctgaatttagtttcttatcttggcttgcgatgttatttgccgctggaatgggggttgggctgatgttttttggcgtagcagaaccattaacccattatctttctgacattacagtaggttctgcagaacataaacaacaagaggctttacttcatactttgttccactggggaattcacgcgtgggcagtatatggcaccattgctttagcattagcttattttgggtttcgttataaattacctttagcgttgcgctcttgtttttatcctttattaaaagatcgtattaatggcaaaattggcgatgcgattgatgttatggcattacttgccacattatttgggattattactacattaggttttggttcatcacagcttggtgcagggcttgaacaaataggttggataagtcagaacagctttgccttacaagttggcgttattgttgtggtgatgtgtttagcggtgttttctgctatttctggtattggaaaaggcgtgaaaatattaagtgaaattaacttaactttagcattttgtttacttctttttgttttaatttcaggccctacgttataccttttatctgcatttagcgacaatattggtaattatttcagcaatttagtgcaactcagttttaaaacctatgcttatgaacaagaacatactagctggtttagcggatggactgtgctttattgggcttggtggtgttcttgggctccgtttgtgggtttatttattgcgcgtatttctaaagggcgaactatccgtgaatttatttttggcgtattagttattccaagtttatttggtattttatggtttactgtttttggtaatacagcagtatggctaaatgatggcattgctgcgggcgggcttggcgaatttatttcttccccagaaattttattatttaaatttttaaattatctgcctttaccaacaataacaggctttgtgagcttattagtgatttcattgttttttatcacttcagcggattcaggtatttatgtgttaaataacattgcatctcgagataaaagtttagcttctcctgcgtggcaagccataatgtggggcactttgatgtcagttgttgcaattgtgctaatgcaatctggtggacttgctaatttgcaaacaatgacattaattgttgccttgccttttgctttattgatgttggtaatgtgttttagtttatggaaaggcttaattgcggataaaaaatatttttctactaaagtcaatccaactagtattttctggagcggcgataaatggaaatcacatttagagcaaatgatgaaccaaacgcaagagaaagatattttacgtttccttaaaaatacggcgttacccgctatgcgagaattacgtcaagaattaacaggaaaatataatttaagtgtagaaatcaacacattatttgaacaagaagagccagctttggaattggtaattcataaagaatcaatgcgagattttatgtatggtattaaatctgttgggcgagaagtgtcagagcaattaattaacgatgaaaatttaccgcacattcagcatagtgttacttacgagccttacacttatttttttgatggacgagtcggttacgatgttcaatatatggatcaagatgaattgattgccgatatgttgaaacaatatgaacgttatctaagtttgcttgatgatgtgggtcaggaactgatggcacacgagcaaaccgaactagcagagtaa

SEQ ID NO: 2560 - DNA, 1356 bp, H. influenzae strain 86-028NP
atgaaaaatagaagccttacgttgcgtcttatttctgtgctttgtttaaccgcactttttgtttggctgggttctacgcttgtggcttggtggcaagttcgccacgatgtgaataaagtttttgatgcacaacaagttctctttgctgaacggctcgcaaattcagatttaagtactattttgttggaatctagcacaacgctaaataaaaattcacagtcggtattaaaaaaaagttatgacgatgatgccttagcctttgctattttttctaaaactgggaaacttttattcagtgatggacgaaatggaaaagattttatttttaattataaaacggggttttataatgcgaatatttatgatgatgacgataaatggcgaattttttggcgtatggcagctaatggagaattagttatcgcagtagggcaagaattagattaccgtgaagatttaattgaagaaatgattttggggcaaatgtggatttggtttgccagtttgcctattttgatcattgttttaggatggttgattcataaagaacttcgaccgattaaacgtttaagccaagaagtacaaacgagaaaatctggcgatgtgtcattgctgaatacggaggggctacccgttgagattttacccttagtaaaaaatttaaatcaattttttgaccgcacttcagctatgttgcaacgcgaacgccgttttacttctgatgcagctcacgaattgcgtagtccattggcggcattgcgtattcaaactgaagttgcgcaactagctggcgatgatgtagcgttacgagaacaagcacttttacatttaacgcaaggcattgatcgggcttcgcaattgattgaacaattattaacgctttcccgcttggataatttgcaagccttagaaacactacagctgcttgattgggaagctattgttcaatcattaatttctgagcgttattttgtggcagaaaaacgtaaaattaccttggtttttgagaaagaatctgaaccaaagcaaaaacaagggcaatcaattttagtttcattgatgcttagaaatttactcgacaatgctattaaatattgtcctgaagatacaatcgtttcagtaaaaatttcatcctcacagattattattgaggacaatggtggtggcgttgaacctgaagatttgaaaaaacttggacagcgtttttatcgtccagctgggcaaaatgaaaagggaagtggcttgggactttctattgttatgcgaattgcggaattacacggatttaaagtgcggttagaaaatgttgtaaaagaggggagaagaattggcttaaaagcaataatatccttgtag

SEQ ID NO: 2561 - DNA, 666 bp, H. influenzae strain 86-028NP
atgagaattttattgatagaagacgataatctaatcggcaatgggttgcagattggtttaactaaacttggttttgcggtggattggtttaccgatggaaaaacaggaatggctgctttaacctctgcatcttatgatgcggtggtattggatttaaccttgcctaaacttgatggattagatgtattgcaacaatggcgatctaatcatcaagatgttcccgtattaattttgactgctcgtgatactttagatgaacgagttaaaggtttacaaagtggtgcagatgattatctttgcaagccttttgctttggctgaagtcgccgcacgtttacaagcccttattcgtcgtcgttatggatatcatcattctgtgatagaacaggctggtgttaagctagatcagaatcaacgttctgtttggctgaataatcaacccatttctttaacaagccgtgaatataaattgcttgaattatttatgctgaataaagattgcgtattgtctcgctcatccattgaagaaaaattatccagttgggatgaggaaattagcagtggcgcattggatgtgcatatttataatttacgccaaaaattggggaaacaatttattcgcacggtacacggtgttggatatgctttgggacaagttgaaaaatga

SEQ ID NO: 2562 - DNA, 366 bp, H. influenzae strain 86-028NP
atgaaaaaatttgcattagcaacaatcttcgcattagcaaccacttcagcatttgctggttttaatggcaataatagtcaaggtggttttcaacaaacagcccctgctgcaattagcgtaaaacaagctttatctgcggctgataattcaatgattactttggtgggtaatattacacaacaaattgatgacgatgaattttggtttactgatgggacagggcaaatcaagattgaaatcaaaaaacgcgtttggaatggtttaaacgtagattcaaaggataaagtgaaaatttatggaaaattggataacgaagcctttgagaaagcagaacttgatgtattgcgcgttgaaaaagcagaataa

SEQ ID NO: 2563 - DNA, 1021 bp, H. influenzae strain 86-028NP
atgatttataaacttacaggctcactccaaaattacgtatggggagggcatcaatatattccagaattactgaatattcctgctgatgaattaccgtatttattaaaaattcttgatgtcgcccaacctctttccattcaacttcatccaacaaaaacgcaagctgaaataggttttgcggaagaaaatgcgaaaggcattgatttaaaagcatcaacacgtacttataaagataacaatcataaacctgaaatgatgattgctttatctgatttctggttgttgcatggttttaaaaataaatcggatattatagaagcttgcaaaaaaattgcaggaacaagatttacctgatttttatgctgatattatgtaggcagatcaaacgctattgtaccaatggttttccccgattctgttagagaatcaagcagcttatgaggctaacaatcttgatttaattaatccagattattgggtgctttacactattgatgcgatgaatatttctttagataaattagatgcaggtttaatttgtttctatttgtttaatattgtacatctcaaaaaaggcgagggaatttcccaagatgctggcattccacacgcttatttgcgtgggcaaaatattgaactgatggcttgttcagataatgtaattcgaggtggtttaacgcctaaatatgtcgatattccagaattgcttaaaattgtcgattgccgtgaagtggagcctaaaattattccaacagcccctcaagacgcacgcatatttacttacgccacgccagcaaaagatttcgatttgcaaaatattcaatatgaatgtggcgaaacacatcatttaaaagcacaaagtgcgagtattttattagtaatgaaagggcagttaaatttacgctcagaaacgaccgcactttctttgaaacaaggtgaggttgcttttattactgcaaatgcttcttatgaagtggacggcttaattgaaggctatgcagtggtcgcaaaattgccttga

SEQ ID NO: 2564 - DNA, 501 bp, H. influenzae strain 86-028NP
atgggcttatttgacaagttatttggttcaaaagaaaacaaatctgtggaagttgaaatttatgcaccgatctctggcgagatcgttaatattgaagatgttcctgatgtggttttctctgaaaaaatcgttggcgatggtattgctgttcgtcctattggtaacaaaatcgttgcgccagtggatggtgtgattggtaaaatttttgaaaccaatcacgctttttcaatggaatcaaaagaaggcgtagaattatttgtacactttggtattgatactgttgagttgaaaggcgaaggctttactcgtattgcacaagaaggtcaatctattaagcgtggtgataccgtgattgaatttgatcttcctttattagaatcaaaagcaaaatctgtcttaacaccaatcgtaatttcaaatatggatgaaatttcttgtatcgtaaaaaaatcaggcgaagtagtggctggagaatcagtagtattagccttaaagaaataa

SEQ ID NO: 2565 - DNA, 1728 bp, H. influenzae strain 86-028NP
atgatttctggcattctcgcatccccaggtattgcctttggtaaggcacttgttcttaaagaagaaaagattgttcttgatacgcaaaaaattacagatgatcaaattgatgaagaagttgctcgattttatgaagggcgtgctgcggcggtagaacaacttaattcaattagagaacgtgcattaatttctttaggcgaggaaaaagccgcaatctttgaaggtcacttgatgattcttgaggatgaagaattagaagaagaaattcttgattatcttcgttcaaataaagtgaatgcaggggttgcagcgagtaaaattttagatcaacaagtgacaatgttatctgaaattgatgatgaatatttgaaagaacgtgcaggcgatattcgggatattgctaaccgtttagttaaaaatattttgggcatgcacattgttgatcttggcgatattcaggaagaatctattcttgttgcttatgatctgactccctcagaaaccgcccaacttaatctcgaaaaagtattaggggttgtcactgatattggtggcagaacttcccatacttcgattatggcacgttctttagaattgccagcgattgtcggcacaaataaagtgactaaattagtcaatacgggcgattacttaattttagatgcgataaataatcaagtttatattaatccaacggcatctcaaattgatgaattaaaagcacttgaagcgaaaatttctgaggaaaaagcagagttagctaaattaaaagatcttccagctattacattggatggacataaggttgatatcgtcgcgaatatcgggacgattcgtgattgtgacggcgcagaacgtaatggagcggaagggattgggctataccgaactgaatttttatttatggatcgtgaacagcttcccacagaagaagaacaatttattgcctataaacaagtggtagaagcaatgaacggacgcttaactgtgcttcgtacgatggatattggcggcgataaagagctttcatatttagatttaccaaaagaaatgaatccattcttgggatggcgtgcaattcgcattgcgttagatcgtcgtgaaattttaaatgcacaattacgtgcggtattgcgtgcttcagcttttggtaaattggcagtgatgttcccgatgattatttcggtagaagaaattcgagaattaaaagcggttattgaaacattaaaggcggaattacgtgaagaagggagagtttttgataataacatacaagtgggtgtcatggttgaaactccctctgcggcggtaaatgcaaaatttttagcaaaagaagtagatttctttagtatcggaactaatgatttaactcaatatactttggctgtagatcgcggtaatgagtttatttcccatctttataatccaatgcacccttctgtgcttggtttaattaaacaagtgattgatgcctctcacacagaaggaaaatggacgggaatgtgtggggaattagcaggggatgaacgcgcgactttattgttacttggtatgggattagatgaatttagcatgagtgcgatttctgtacctcgcattaaaaaattaatccgtaatgtaaatttccaagatgcaaaagcgcttgctgatgccgcattacaaaaaccgaccgctgcagaaattgatcaattaattgaagaatttttgctggaaaattcattaaattaa

SEQ ID NO: 2566 - DNA, 258 bp, H. influenzae strain 86-028NP
atgtattcaaaagatgtggaaattattgcaccaaacggtttacacacgcgccctgctgcacaatttgtgaaagaagcgaaagcattttcttctgaaattacagtaacctcaggggggaaaagtgcaagtgcaaagagcttatttaagttgcaaacattagttttaacgcagggaacaatacttaccatttctgctgatggagaagacgagcaacaggcagttgaacatttagttgcgttaattcctactttagaataa

SEQ ID NO: 2567 - DNA, 1041 bp, H. influenzae strain 86-028NP
atggctaaacgtaaattaactcaaaaccaaactagaagaattcaatcgaataatgcgaaaacattacatcgccataagaaaaaagacattgaatggtcagatgaaatgcttggcgaatcacaagaaggcgttgtggtcacacgttattctattcacgcagatgtcgaaaatgaacaaggcgaaatttatcgttgtaatttgcgtcgtaccttgtcgagtttggtggtgggagataaagttgtttggcgtaaaggcaatgaacaattacaaggtgtgagtggcgtgattgaggcgatccatccccgagaaaatgaaatttcccgccctgattattatgatggtttgaaacctattgcggcgaatattgatcgtattattattgtatcagcggtgttgccaacgctttccttaaatattatcgatcgttatcttgttgtgtgtgaaattgcgggaatcacgcctctcattgttttgaataaagtggatttattggcacaagaacagcgtcaagaaattgaagaccaacttaaaatttaccaagatattggctatgaaattttaatgatttcagcaaagagcggtgaaaatatggaaaaattgaccgcacttttggcacaaggcacggcgatttttgttgggcaatctggtgttggtaaatcgagtttaattaatcatattttgcctagcgtaaacgctcaagtaggggatgtgagcgaaacatcaggcttagggcagcataccacgacatcgtcacgtctttaccatttgccacaaggcggtaatttaattgattcgcccggaattagagaatttggcctttggcatttagatgcagagcaaatcacaaaaggctatcgagaatttcaatatgttttgggcacctgtaaattccgtgattgtaaacatttgagcgaccccggatgtgcgttgcgtgaagccgttgagcaaggcaaaatttcgcctgttcgttatgatagctatcatcgattaattgaaagtttaagtgaaacaaaatcacaacgtcatttttcattagtttaa

SEQ ID NO: 2568 - DNA, 549 bp, H. influenzae strain 86-028NP
atgccattcgataaacaaaatcttatttggattgatttagaaatgaccggtttagatccggaaaaagaacgtattattgaaattgcgactattgtgacagataaaaatttaaatattttggcagagggcccagtattagcggttcatcagtctgatgaattactcaataaaatgaatgattggtgccaaaaaacgcatagtgaaaacggcttaattgaacgcgtaaaagccagcaaacttaccgaacgagcagcagaattacaaaccttagactttttaaaaaagtgggttcccaaaggtgcatcgccaatttgcggtaacagcattgcccaagataaacgcttcttagtgaaatatatgccagatttagccgattattttcattatcgccatttagacgtgagcacattaaaagaacttgctgcacgttggaaacctgaaattttagaaggctttaaaaaagagaatacgcatttagcgctagatgacattcgagaatccattaaagagctggcttattatcgcgaacacttcatgaaattagattga

SEQ ID NO: 2569 - DNA, 1068 bp, H. influenzae strain 86-028NP
atgctgagtatttttgttacttttcttggcgcgtttttaacattgattgtgatgcgaccacttgccaattggattggattagtcgataaaccaaactatcgtaaacgtcatcaaggcacaattccactaatcggtggcgtatcgctttttgttggtaatctttgctattatctgatggaatgggatcaacttcgattaccgtatctttatttgttcagtatttttgttttattggcgattgggattttagatgatcgctttgatattagcccttttttaagagcaggcattcaagcaatattggcgattttaatgatcgatcttgggaatatttatcttgatcatcttggtcaaattttagggcctttccaattaacgcttggttcaattggtttgattattaccgtctttgccactattgcgattattaatgcctttaatatgattgatggtattgatggattgcttgggggactctcttgtgtttcttttgcggcgattggtattttaatgtatcgagatgggcaaatggatatggcgcattggagttttgctttaatcgtatcgattttaccttatttgatgctcaatctagggattccatttggaccaaaatataaggtgtttatgggggatgccgggagtacattaattggctttaccattatttggattttgttattaagtacgcaaggaaaagggcatcctatgaatccagtaaccgcactttggattattgcgattcctttgattgatatggttgcgattatttatcgccgtgtacgtaaaggtaaaagcccattccgtccagatcgtttacatgttcatcatttaatggtaagagcgggtttaacatcaagacaagcctttttattgattacgtttgtttctgcagtttgtgcaactatcggtattttaggggaagtttattatgtgaatgaatgggcgatgtttgttggctttttcattttatttttcctttatgtctattcaattacgcatgcatggcgaattacccgttgggtaagaagaatgaaacgtcgtgccaaacggttgaagaaagcataa

SEQ ID NO: 2570 - DNA, 2592 bp, H. influenzae strain 86-028NP
atgctgttttctccgacactatcttctcctttaacgccaagtgcggtcaaaattgaacgagaaaatctcaagcaatttgagctcgagaatttttctcgttattccatttttgagcttattgaaaatcgctgtgatttttatgatgccttattgattcaactttggcaggaaatagaattaagtgaacaactggggattgctttaattgcggtgggcggttatggacggcgtgagatgtttcctttgtcggatttagattttttgattttagtcgagcaaaccccaagccctgagattgaagaaaagattactcaatttatccagtttttatgggattgcggttttgaggtgggaaatagtgttcgaaccttagaacaatgcgaatcggaagggaaacaagatattacgattgccaccaatttattagaagcaagatttcttgctggaaatcgaccgcactttgatgcattaaatgaattggtaaaacgtgcagatttttggtcgaaagaagatttttttaatgccaaagtgcaagagcaaatagaacgttatcagcgttatcacaatacggcttataaccttgagccagatattaagtacagccctggaggcttgcgtgatttgcatttgttgtattgggtggcgttgcgccattctggggctttgacccttgaggctattttacaaagtggttttatttatcctcaagaatatcagcaactacaagaaagtcgtgcatttttatttaaagtgcggttcgctttgcatttgattttgaaacgttacgataatcgtctgttgtttgatcgtcaaattaaagtcagtgaattattgggtttccgaggggaaggcaatccagctgtggaaaaaatgatgaaatgttttttccaagcattgcaccgaatttcgctgattagtaatttactgattcagcattatcgagaaaatgtgcttccatcaaatcaggatactgtaattgaccaattagacgatgattttcaactgattaaccaatgcttatgtttgcgtaatagctttgtttttcaagaaaaaccagcgcgaattttagatctattcttttatttaacgcagtacgaacatgccaatattcattctgatactttgcgtcaattacaaatttccttagatcaattatcacaaaaattatgcgaaattcctgccgctcgggaaaaatttctacgtttatttaatcaacctaatgcaattaaacgtgcgtttatgccgatgcaccaatatggtgtattaactgcgtatcttccgcaatggcaagccattgagggcttaatgcaatttgatttgttccacatttatacggtggatgagcatacattgcgcgtgatgttgaaattggaaagttttctgtcacaggaaagtgcgcaagaacatcccattgctcatcgaatttttagccaactttctgaccgcactttgctttatattgcggcgttgttccacgatattgcaaaagggcgaggtggtgatcacgcagaacttggtgctgtggatattgcagactttgcacaattacatggtttagatcgtcgagaaattgatacccttgcttggctcgtaaaatcccatttgctgatgtcaattacggcgcaacgccgtgatattcatgatcctgaagtcgtcatgaattttgcggaagccgtgcaaaatcaagttcgattagattatctgacctgtttaacggtggcggatatttgtgcaaccaatggtaatttatggaatagctggaaacgttcgctttttgcctctttatatgaatttacaggacggcaattttcacaaggcatgaaagaattgcttgattattcagaaaaatcggcagaaaaccgaaaacttgcacaacaaattttaatgcgggattattctgatattacgccaatttcgattgagcaattatgggctcgttgtccagaagattattttgtgcgtaatacgccaaaacaaattgcgtggcatacaagtttgctggtggatttcgttgaggcattattagtgaaaattagtaatcgcttttcacttggcggcacagaagtgtttatttattgccaagaccaaccgcacttatttaataaagtggtgagtaccattggcgcaaaaaaattcagtatccacgatgcacagattattacgacacaagatggttatgtttttgatagctttatcatcacagaacttaacggagaattggttgaatttgatcgtcgccgagaattagagcaagccctaacattagcccttcaaagtgaaaaattgcccgcactttctattgtgcctaatcgccagcttcaacattttactgtacaaaccgacgtgcgttttttacaggaaaacaaaaaagaacatactcaaatggaactggttgccttggataaagcagggttattagcccaagtgagccagatttttactgagttaaatctaaatttattaaatgcgaaaattaccaccgtaggcgaaaaagccgaggatttttttattttgacgaaccaatttgggcaagctctggattctcaacaaagagaaatattacgtaacgtgctgtatcgaaatattggatag

SEQ ID NO: 2571 - DNA, 807 bp, H. influenzae strain 86-028NP
atggctattccaattagaactgaaaaagaaattgtaaagttacgtgaggcatgcaaattggcttccgatgtgctggtaatgattgaaccttacgtaaaagcaggcgtaaccacaggcgaacttgatcgcatttgccatgaatatatggtaaatgaacaaaaggttatccctgcgtgtttgaattatcacggtttcccaaaggcgacctgtatttccattaacgaagtcgtttgtcacggtattccaagtgacgataaagtgttaaaaaatggcgatattgtgaatattgatgttaccgtgattaaagacggttattttggcgataactcaaaaatgtatatcgtgggtggcgaaacgaatattcgtagtaaaaaattagtggaagcggcacaagaagcattatatgttgggatacgcactgtaaaacccgatattcgtttaaatgaaataggtaaagccgtgcaaaaatatacggaaagccagactttcagcgttgtgcgtgaatattgcggacacggcgttggtacggaatttcactgcgaacctcaagtattgcattattacgccgatgatggcggcgtgattttaaaacccggaatggtgtttactattgagccaatgattaacgcaggcaaaaaagaagtgcgcgtaatgggagatggttggacagtaaaaaccaaagatcgcagccattcagcacaatacgaacatcaacttgttgtcacggaaactggttgtgaagtaatgactatccgcgatgaagaaattgcagaaggtcgaatttcgcggattatggtgaatgtgtaa

SEQ ID NO: 2572 - DNA, 345 bp, H. influenzae strain 86-028NP
atgatagatgatatggcggtgccactgacatttactgatgcagcggcaaataaagtaaaaagtttaatcagcgaagaagaaaatactaatttgaaattacgcgtgtatatcacagggggtggttgcagcggtttccaatatggttttacctttgatgaaaaagtcaatgacggcgatttaaccattgaaaaatcaggggttcaacttgtgattgacccgatgagcttacaatatttaatcggcggtacagtcgattatactgagggtttagagggttcacgttttactgtaaataatccaaatgctaccagcacttgtggctgtggttcatcctttagtatctaa

SEQ ID NO: 2573 - DNA, 354 bp, H. influenzae strain 86-028NP
atggattttcaatttacacattatcaaggcaatgtatccgtcaaatgttcgatggaacacattgcccttgctaactggttcaacacagaagtgcggtcaaattcagacaagattttaaccgcactttctactgcaaaatcacttattgaaaatcaagaaaaagtcttagtcggtgcggaatatacgttatttttaaatgctgatgaagtaatggtgcgcgccaacaatctcgccattgaatcagatgaaattttagaacaagatttccattattatgatgaagaaagccttgctttttgcggtacgcaagattttattcattttctccaatcttatgttgattttattgcttaa

SEQ ID NO: 2574 - DNA, 2346 bp, H. influenzae strain 86-028NP
atgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgcttagaaagtgtgaaaattgccgataatctcgcttttgatgaagtcattcaaattttattagataacgaatatcgccaaactacaatggttgccgcacctggcgatttcaaattagaagatgatagcattgtaatacttcgccgtgcttttcctttccccgataaagcagagcctcagcgagttttgcgcttgcgttttagccataataagttatctcgcattgaagatttagtcacagtcaaaactgttgatgaatttcgtcttgcaccaaagttgattgcgatgttgcaatcagacaacgaagatcgtttagctattcctttacaaaattatccccgtttattaattgatacattaattttaacggaagatcgccgcttttatgaacataatggcattaatccagtggggattttacgcgcattaattgcgaatattcgtgcaggtcaaacggtacagggcggaagtacgctcactcaacaattagtcaaaaatttatttttatcgcgcgaacgcaccattacacgtaaagccaacgaagccttgatgtcattggttttagattggcgttacgataaaaatcgcattctcgaaacctatcttaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccttggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtgaactgggcgaacacaaaatatccagtttacttggcgcacgtattttttccacaatggatttaaaacaacaagctcaagcagaaaatgcagtggtcaataccgtttcgcaattacaactgaaaatgaaaaatccccatttagagggagcgatgattataacggattatcgcacaggcgaaattcgtgcagtagttggcggtttacaaacgcaatatgcaggctttaatcgtgcattaatggcaaaacgtcagattggttctttagtaaaaccttctatttatttgaccgcactttctaacccagaacagttccgtttgaataccccaattaataaccaaccaataacaattaatgtcaaaggtagcccgccgtggcagccacgcaactatgacaaaaaatatagtgattcagtaatgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttatagcatttcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctgtttggctaaataatggtcagaatttctgtggcgaaacatcatctccctctctcacgccaacaactgaaacagaaacaccaccacaagaaagcctgtgggacgtattggataatcccaatccacccgctcaataa

SEQ ID NO: 2575 - DNA, 921 bp, H. influenzae strain 86-028NP
gtgcggtacaatacgcaccagtttttactttcatacaggtgcaaaacaatgacacaacaactccccattttaagtctaaaaaaaatatattcaggcaaagtacgcgatctctatgaaatcgatgataaacgcatgctaatggttgcttctgaccgcttatctgcctttgatgttattttagatgatcccattccacgaaaaggcgaaatcctaactcaaatttccaatttttggtttaataaacttgctcacattatgcccaatcatttcactggcgacagcgtttatgatgtgttaccaaaagaagaagcggatttaatcagaaatcgcaccgtcgtgtgtaaacgtttgaatcccattaaaattgaatctatcgtacgtggttatttaactggcagtggtttaaaagattacaaacaaactggcacgatttgcggattaaaattgcctgaaggcttggtggaagcgagtaaattacccgaagctattttcacgccatcaagcaaagaagaagttggcaaccacgatataaatattagctatgcagaatgcgaaaaacttatcggagctgatttagccgcacaagtaaaagaaaaagctatcgcactttataccgtggctgcagaatatgcactcactaaagggattattatttgtgacacaaaatttgaatttggtttagatgaaaatggcacgctcactttaatggacgaagtattaacgccagattctagccgtttttggtctgtggatacttaccaagcaggaacaaatcccccatcattcgataaacaatttgtgcgcgattggttagaaaatagcggctggaataaacaagctcccgcaccaaaagtgccagaaaatattattcagaaaaccgttgataaatatcaagaagcactggatttattaacaaaatga

SEQ ID NO: 2576 - DNA, 1335 bp, H. influenzae strain 86-028NP
atgtcaaatactattctacagaatttacctaaaggacaaaaagtagggatcgctttctctggtggtttagacactagtgcagcattactttggatgcgtcaaaaaggcgcagtgccttatgcctacaccgctaatttagggcaacccgatgaagatgattacaatgcaatccctaaaaaagccatggcgtatggtgctgaaaatgctcgattaattgattgccgctctcaacttgctcatgaaggcattgccgcaattcaatgtggtgcattccatatttctacaggcggcattccttacttcaatacaacgcctcttggtcgcgccgtaacaggcacaatgcttgtagcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtgcctgtggcattaaatggcaaacattttgataatgctgttgatcttattctagaagccaatcgtattggtgggcgtcacggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacccttgaacttcgtcgtggtaacgacttcacaattttaaataccgaatcgccaaacttaacctacgaagcagagcgtttaagtatggaaaaagtggaagatgcgccatttgatccagttgatcgtatcggtcaattaacaatgcgtaatttagatgtatcagacacccgaggtaaacttggcatctatgcacaaacaggtttattaagcgcaattaaagattccgtattgccacaattaggcaaaaaataa

SEQ ID NO: 2577 - DNA, 1194 bp, H. influenzae strain 86-028NP
atggcatcaattactcacagacgaaatgcggttttaggggcagctttcttaatggcgacatccgccataggccctggatttttaactcaaaccgcaacctttacaaatactttattagcgagttttggctttgttattttattatcaattttgttagatattggggctcaacttaatatttggcgaattgttattgtgtctggcaaacgcgcgcaagatatttctaatgcggtttttccgaaagcagggtattttcttgctgcgctgattgtgatgggcgggctggcttttaacattggcaatgttggcggcgcggggcttggtttaaattctatttttggtatagcaccagaaatgggcgcagtgattagtggtattattgctattttgatttttttgcgtaaagaagcaggcttattaatggatcgttttgcgcaattaatgggctttattatggttgcgctcacattttatgtaatgtttaaaactgaaccacctgtggctgaagcagcgtatcattcctttattccagaaaaaattgatcctattgctattgttacattagtggggggaaccgtaggcggttatattacttttgcaggcgcgcatcgtttattagatgcgggcattcaaggcgaaaaagcaatggctgaagtgagccgtagttctgtatcagccattttaattgcttcaacaatgcgtgttgtattatttcttgcggtgcttggcgtggtgtcaaaaggtgtgtctcttaatcctaaaaatccagctgaaacgccttttgaatatgtagcaggcaattttggtcaagtgttatttggagtggttatttgggcagcgtctgtcacatctgttattggtgcggcttatacttcagtttctttcttaacgaccctttgtccaaccattgaacgcaatcgtaatcgttggattattgcttttattgtgatttctactgttgttttagtcactgtgggaaagcctgctgcggtattagtctttgtgggaacattaaatggcttaatattgccgattgcattggcattaattttgttagctgcttacagaagtgatattgttggcacttataaacaccctgtttttttagctttttcaggctggtttgttgtgattattatggcaatattaagtggaaaaacgattatttcttatatttctagtttttttagctaa

SEQ ID NO: 2578 - DNA, 738 bp, H. influenzae strain 86-028NP
atgaaaaaaattgatttaaatgcagatattgcagagggttttccttttgatgaaagtttattgcagttgctttcttctgcaaatattgcttgtggcttacacgctgggggcgcaaaggaaatgcaaagtgcggtcaaatttgcgaaagaaaataaggtgcgtattggtgcacatcctagttttcctgatcgcgaaaattttggtcgtacggcaatggcgttgtcttcacaggaattaatcgcacatttgcgttatcaattgggggcattaaaagcgatttgtgatggcgagggggcggtaattagttatgttaaacctcacggtgcgttatataaccaagcagcaaaagatgaaaaaatagcgcgtgtaattgcacaaaccgtttatcaatttgatccgaatttgaaattaatggggttagcaggcagtttaatgttgcgcatcgcagaggaagaaaaattgcaaacgatttctgaagtttttgccgatcgacattatatgcctgatgggagtttggtgcctcgttctcaaccaaatgcaatggtggaatctgataaggaagccattcaacaagtgttacaaatggtaacaaaggggcaagtcaatgccattgatggaagccttgtgcctgtaaaagcagaaagtatttgcttacacggcgataatcaacattctttacaatttgctaaacgcattgtggaagaattagaaaaaaatcatatcaaaataacggcataa

SEQ ID NO: 2579 - DNA, 930 bp, H. influenzae strain 86-028NP
atgattgatattcttgatgtgaaatcccgcgccaccattcaagatttagggcgttttggtttacgccgatttggcattagccattgtggggcaatggataaattagcattacgcgcaggcaatattttattgggcaatgcagagaatgttcctgccattgaagtgcctttaggcggtattacattgcaatttcagcaagatatgaatttttgtgtgactggtgctttttatgaaatgatgttagatgataagcccgtttttgcttattggcgttatcaagtgcgagcaggtcaaatattaaaaatgacacgtgcaaaaattggaatgtatggttatttatgtgttcaaggtggttttgttttgcctcaagcattgaattcttgcagcacggatttgagagcggaaatagggggcattgaggggcgttgtttgcaggcgggcgatcaactacaaacggcaaatgatcatattttgcgtagcgaaattggtattgcaccgattccgcttcgagatgttattcgtgctttgccatcttctgaatatcaggcgtttaaacgaaaatcccaatattattggtggcgaaatgaatggacgttgcaaagtaacagtgatcgtatgggttatcgttttcaaggtcagacattagaattaaagcagccgttggaaatgctatctcacgccattcagtttggtagtgtgcaagttccaccaagtggtcagcctattattttgatggctgatgcgcaaaccacaggcggttatcctaaaatcgctaatgtgattgatgctgatcttggggctttggcacaggtacgtttaggttcaacgattaaatttgaagcggttagcttacaagaggctgctaaattacgccgtaaaaatgaaatataccttgatcaaattaggagaattgttgatgaaaaaaattga

SEQ ID NO: 2580 - DNA, 642 bp, H. influenzae strain 86-028NP
atgaatatcgttccgatcagtgaatcggcggtggtttgctctttgccacccccagcttccattcaacaacaacgccaattatgggcgtttgctcgtcaattgcaatcagaacaagatattgtagaagttgtcttgggaatgaataatcttacggtttttaccgattttttcgtggattttaagccgcttgtgcaacgtttagaacaactttgggctgagttgaaagtatcggattttcaagggcgtcatattgaaattcctgttatttatgggggagagcgaggtcaggatttatctgatgtagcgaaatttcatcagacaacaccaaagcggattattcagatgcacagtgagcctatttatactgtgtatatgattggcttccaagcgggctttccttatttgggtggtttacctgaaaatttacacacgccgcgtcgcgccacgccaagaacggttgttcctgctggttctgttggtattgggggtgcgcaaacggggatttatcctttttcttcgccaggtgggtggcagttgatcggttatactaaacaagcactttttgataaaaatcaagcacaaccaaccttattacaagctggcgatactgtgaaatttattgtggatgggattgaactatga

SEQ ID NO: 2581 - DNA, 1980 bp, H. influenzae strain 86-028NP
atgtttcaagataatcctctactcgcacaacttaaacaacaaatccacgacagcaaagaacaggttgagggcgtggtaaaaagcacagataaagcctacggttttttagagtgcgataaaaaaacctatttcatcgcaccgccatcaatgaaaaaagtgatgcacggcgacaaaatcaaagccactattgaaaaacaaggcgacaaagaacaagccgagccagaagccttaattgagccaatgctcacacgttttatcgcaaaagtgcggttcaataaagacaagaaattacaagtgctggtggatcacccaagcattaatcaacccattggtgcacaacaggcgaaatcggtaaaagaagaattgcaagagggcgactgggtcgtcgcaaatttaaaaacccatccattacgtgacgatcgctttttctacgccacaattaatcagtttatttgccgagctgacgatgaattagccccttggtgggtcacattggcacgccacgaacaatcgcgctatcccgtgcaaggcgcagaacattatgaaatgttagatcaaaaaacacgcgaaaatctgaccgcacttcattttgtaaccattgattccgaaagcacaatggatatggacgatgccttatatatcgaacccatagcacaaaacagcacacaaacaggctggaaattagtggtcgccattgctgacccaaccgcttacatcgccttagattctcaaattgaacaagaagccaaacagcgttgcttcacaaattatttaccgggctttaacattccaatgttaccccgtgaattatccgatgaattatgttccttaatcgccaatgaaacccgccccgcacttgtctgttatatcgaaaccgatcttgcaggcaacatcacagccaaaccgcattttgtttccgcttatgtacaatctaaagccaaactggcttataacaaagtgtcggattatttagaacaggcagacaatgcatggcagccagaaacgccagaaacagcacaacaaattcactggctacatcaatttaccaaagcccgcattcaatggcacaaaacccattccttactctttaaagaaaaacccgattatgcctttgtgctggcagaaaacggcaaagtgcaagaaatcaaagcagaatatcgccgcattgccaatcaaattgtggaagaagcaatgattattgccaacatctgcgccgcacaatttttacacgaacaggcaaaaacaggcattttcaacacccacagcggttttgataaaaaattcttagagaacgcacaccatttcttaatggcaaatttagccaatgaacaaaatcaaactgaactggcagaacgttattcagtagaaaacttagcaaccttaaacggctattgccaaatgcgccacgatattgaacccatcgaaagcgattatttagaactgcgtttacgccgttatttaactttcgccgaatttaaatcagaattagcaccgcactttggtcttggtttagaaggctatgccacttggacatcgcccatccgcaaatattcagatatggttaatcatcgcttaatcaaagccgtgctggcaaaacagccttatgaaaaaacacaaaatgacgtgttggcacgtttgcaagaggctcgccgccaaaatcgcctcgtagaacgtgatattgcagattggctatattgccgttatcttgcaccgaaagtggctgaaaatgtggaatttaatgcagaagtgcaagatgtaatgcgtggtggattacgtgtgcaattattagaaaatggcgcctcaatgtttatacctgcgtccactttacataataataaagaagaaatgcaggtgaattcagatgagattgccctttatattaaaggcgaacgcacttacaaaataggcgacattgtgaaagtgaaactcacagaagtgaaagaagcaactcgcagtattgtgggcgaaatacttcaataa

SEQ ID NO: 2582 - DNA, 888 bp, H. influenzae strain 86-028NP
gtgcggttggttttcttagaaatattggtctgctttgtacaaagacaaattttcgcttatactacgcaagttttttacgctaacaacataggaaaaattatgggtttcttaacaggtaaacgcattttagtcacaggtcttgcaagcaatcgttccatcgcttacgggatcgcaaaatcaatgaaagaacaaggtgcagaacttgctttcacttatttaaacgataaattacaaccgcgcgtagaagaatttgccaaagaatttggttctgatatcgtgcttcctttagatgtggcaaccgatgaaagcatccaaaactgctttgcagaattaagtaagcgttgggataaatttgatggttttattcacgcaatcgcatttgcaccaggtgatcaattagacggcgattacgtaaatgcggcaactcgtgaaggctatcgtatcgctcatgatattagcgcatacagctttgttgcaatggcacaagcggcacgtccttacttaaatccaaatgccgcattattaacgctttcttatttaggtgcagaacgtgcaattcctaactacaacgtaatgtgcctagcaaaagcctctcttgaagctgcaacgcgcgtgatggctgctgatttagggaaagaaggtattcgtgtgaatgcaatctctgcaggcccaatccgcaccttagccgcatcaggcattaaaaacttcaaaaaaatgctttccacctttgagaaaacggctgcattacgtcgcactgtcactatcgaagatgtgggtaactcagcggcatttttatgctctgatttagcatcgggcattacaggcgaaatcgttcacgttgatgcaggtttcagcatcactgcaatgggcgaattaggcgaagaataa

SEQ ID NO: 2583 - DNA, 1584 bp, H. influenzae strain 86-028NP
atgagttatccattagaagaagttaataaacgtcgcacttttgcgattatttcccaccctgatgcgggtaaaacaacgattactgaaaaagtacttttatacggcaatgcaattcaaactgcaggttctgtaaaaggcaaaggctcggcggctcacgcgaaatctgactggatggaaatggaaaaacaacgtgggatttcgattaccacttctgtgatgcaatttccttataataattgtttagtgaatttgcttgatacccccggacacgaagatttctctgaagatacttaccgcactttaaccgctgtggatagctgtttgatggttattgactctgccaaaggggtggaggaacgtacgattaagttgatggaagtcacacgtttacgtgatacgcccattattacgtttatgaataaactcgaccgtgatattcgtgatccgatggaattgttggacgaggtggaaaatgtgttgaaaattcgttgtgcgccaattacttggccaattggctgtgggaagttgtttaagggcgtttatcatcttgcaaaagatgaaacctatttatatcaatcagggcagggttcaaccattcaggcagtgcgtgttgttaaaggcttgaataatcctgaattagatgttgctgttggcgatgatttagcacaacagcttcgtgatgaattggaattggtgcaaggcgcaagtaatgaatttgagcaagatgcctttattaagggcgagcttacccctgtatttttcgggacagcattaggtaattttggggtggatcattttcttgatggcttaacacaatgggcgccgaaaccgcaatctcgtcaagcggatacaagaacggtggaaagtgcggaagaaaaattcagtggttttgtgtttaaaattcaagccaatatggatccgaaacaccgtgacagagtggcgtttatgcgtgtggtttcgggcaaatatgaaaaagggatgaaacttaaacacgtccgtattggaaaagatgtggttatttctgatgcgctgacttttatggcgggcgaccgtgctcacgccgaagaagcttacgctggtgatattattggtttacataatcacggtacgattcaaattggcgatacgttcacgcaaggcgaaacgctgaaatttacaggcattccaaattttgcgccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatggaaaaaaatttgaagaatttaaacgtaaaaacgagcaaaatttagccttagatggcggcgataatttaacctatattgcaccaacaatggtaaatctaaatttagctcaagaacgttatcctgatgtcgttttttacaaaactcgcgaacattaa

SEQ ID NO: 2584 - DNA, 234 bp, H. influenzae strain 86-028NP
atggattttaattttattgagtttttaggttatatggcgactttttttgttgctgtatcttttttatttaaatctattgtgtatttacgcattgtaaatagtatcggcgcgattttatttgttatttacagcgtaattatcacagcataccccgttgcattattaaatgcctttttagttgtggtaaatatttatcaactttggcgattaaaacaagaaaatctctctaaataa

SEQ ID NO: 2585 - DNA, 330 bp, H. influenzae strain 86-028NP
atgacattaacagaacaaatcattaccattggaatttgtatagtggcggtacaatttacacgtttattaccattttttgtatttcctgttaatcgccccattccacaatatatccgttatcttggaaaagttttaccccctgcaatgtttggtatgcttgtcgtttattgctataaaaatattgagattttaactggctatcacggtattcctgatttgcttgcagggatagtcgtgcttggcttacatttctggaagaaaaatatgtttctatctattgctgttggtacgcttttctatatggctctcgttcaacttatttttatataa

SEQ ID NO: 2586 - DNA, 735 bp, H. influenzae strain 86-028NP
atgaatttatctcaacaaaatcaacactctaacccaattactgaagcggctaaggctgcttttccctacagcgtaccaatgattgcaggatttttatttcttggcatagcatacggtatttatatgaaagcacttggtttcggatttttatatcctactttgatggctttacttatttatgcgggttctgttgaatttattgcagcaggcgcacttattgcacctttctctccaatcagcgtattattaattaccttaatgattagtgcccgccaaattttttatggcatatcaatgctagaaaaatatggcatacatataggaaaaaaacgttggtatttaatcacaacacttgtagatgaatctttttccctaaattatatggcaaaaatcccacagcacttagataaaggttggtatatgttttttgtgagcttatatttgcatatttattgggtacttggcgcagcaatggggaatttatttggtactgttttaccttttaatttaaaaggtgtggaattttcaatgacagcactattcttagttatttttgcagaaaattggctaaaagaaaaatcccacgaaagctctctcttaggtttagggattgcatttgcttttttacttattataggaaaagaatattttttaattccaacattaattggcatttggttaattctaactatgcgcataactaaattagaaacaaaattggaatctttaaaatga

SEQ ID NO: 2587 - DNA, 930 bp, H. influenzae strain 86-028NP
atgaaaccaacctttctagaatttagacatcttaaaactttattggctttaaaagagacaggcagcgtttctctagctgcaaagcacgtatatctaacccaatcagccctttctcaccaaattaaattaatagaagaacaatttggcttgcctttatttgagcgtaaaagtaatccacttcgttttacttcagcgggagagcgtttaattcgtcttgcgaatgaagtaatgccgaaagtgattgatgctgaacgtgatcttgcaagggtaaaacacggcgatgcaggacagttacgtatagcggtggaatgccatacttgttttgattggttaatgccagcgatggatgaattccgtcagcattgggggctagtagaactggatattgtatctggctttcatactgatcccgttggtttattactttcccatcgagcagattgggcgatagtatcagaaatagagcataatgatgatgtcatttttaaaccgctcttttcttatgaaatggttgggatttgctcaaaaaatcattctttagcagaaaaagatatttgggaagcggaagattttattgatgaaacttgggtaacttaccccgtacctgacgatatgttagatctatggcgtaaagtgcttaaatcaaaaggcattaatcctactcgccgtacaacagaacttactattgcaatgattcaacttgttgcgagtcgtcgtggtattgcgactatcccttattgggctgcgctgccttatttggaaaagggttatgtcgtggcaagaaaagtcacaaaagaaggtttatatagcaatctatatgcggcgattcgcaaagaagatgaatccctttcttatttagaagatttttatcaaacagtcaaatctcaaagtttctcaactttacccggactttctgttttaaatttatag

SEQ ID NO: 2588 - DNA, 1146 bp, H. influenzae strain 86-028NP
atgattatttcatcagctagcgattatcgtgaagcggcgcgccgccgtgttcctccctttatgttccattatgccgatggcggttcttatgccgagcaaacacttgcgcgtaatgtgagtgatttggaaaatattgctttaagacaacgtgtcttaaaagatatgtctgaattggatactagtatagaattatttggtgaaaaactttcaatgccaactattcttgcaccagttggggcgtgcggaatgtatgcacgtcgtggagaagtacaagcagcacaagcggcagataataaaggtgtgccgtttaccctttcaacagtatcaatttgtccaattgaagaagtcgcccctgcgattaagcgtccaatgtggtttcagctttatgtgttaaaagatcgtggttttatgaaaaacgcacttgagcgtgcgaaagcagcaggctgttctactttagtgtttacggtcgatatgcctactccaggtgcgcgttatcgtgatatgcactcaggtatgagtgggccttacaaagaaattcgccgtgtattacaaggctttacacacccattctgggcgtatgatgtgggtatcaaaggcaaaccgcacaccttgggtaatgtttcaacttatatgggtagacaaataggtttagatgactatattggctggctaacagaaaactttgatccatcaatttcgtggaaagatttagagtggatccgtgagttttgggaaggtccaatggtcattaaaggcattctcgaccctgaagatgcgaaagatgcggtgcgtttcggtgctgatggaattgtcgtttcaaatcacggtggccgtcagttagatggcgtgctttcaagtgcaagagcgttgccaccgattgccgatgcagtgaaaggggatattaaaattattgccgattcaggtattcgcaatggtttagatatagtccgtatgttggcattaggggcagatgcaacaatgttaggtcgagcatttgtttatgctttaggggcagcaggtcgtcaaggtgttgaaaatatgctcgacattttcaaaaaagagatgcgcgtagcgatgacattaaccagcaatcgtactattgtcgatattaaaccagaggctttggttgatctaagtaaactttaa

SEQ ID NO: 2589 - DNA, 810 bp, H. influenzae strain 86-028NP
atggataaaaaagaaaaacgcccaactgtacttttttttgactctggagtgggtgggtttagcgtataccgtgaagctaaaaaattattacccaattggcattatctctattgctttgataatgcgggattcccttattcagaacgcgaagaagaaagtattattcaccgcactttagcggcgtgtcagcttattaatcaacgttatccattagatgcaatcgtgatagcttgcaatacagcgagtactgttgtgcttccgcctttgcgagctgcttttgagattcctatcattgggactgttcccgctattaaacctgcatcagaaataacaaagacaaaacatattggtttattagctacaaagggtacagtaaagcgtcattatatcgatgagttgattgataaatttgcgcaagattgtattgttgagagactgggaacgacaaaattagtcgaaattgcggagcaaaaaattcgtggtcattccgttgatctcattagtttaaaagatgagttatcttcgtgggcaggcatggcagatttggatacattagttttaggttgtactcactttcctctcatcaaagatgaaattcagttatgcttgccacaagttaaatattttatggatccgagcgcagcaattgctaaacggatcaaatatttacttgatgataaaaatctacaagtgcaaaatgaaaaatataatcaaatgttttgcaccgcacattttcccgaagaatctcaatttaaaaaagctttacatctatggggatttgaatctttggaagtaatcaaaatagattaa

SEQ ID NO: 2590 - DNA, 2082 bp, H. influenzae strain 86-028NP
atgagccttgaacttctcgatgccgtgcctttgaccagcctttctggtgtgggggctgccatttctaataaactggctaaaatcggcattcagaatctgcaagatttactctttcatttacctattcgctatgaagatcgtacgcgaattacgccaatcgctaatcttcgccctgaacaatattttactatagagggaattgtacaaacctgtgaagtcgcttttggccgtcgcccgattttatcggtaagtttgtcagacggcacatcgaaaattatgttacgttttttcaattttaatgcgggaatgcgtaatagttttcaagcaggtgtgcgagtaaaggcctttggcgaagtgaaacgtggtcgccatatgccagaaattcatcatccagaatatcaaattgtgcgagataatgcgcccatagtattggaagaaaccctaacgccgatttattccacaacggaggggttaaaacaaaattcattacgaaaattaacggatcaggctttgacattactcgacaaggttcagattgcagaaattttgcctaatgaatttaatccacatcaatatagcttaaaagaggcattgcgattattgcatcgtccgccgccagatatttcattagaaatgttagagcaaggtaagcatcctgcacaacaacgattaatttttgaagagcttctggcacataatttagctatgcaaaaagtgcggttaggaacgcaacaattttctgccttaccgctacattatcaaacagatttgaaacagcgatttttagccaccttgccatttcaaccaactaatgcgcaaaagcgagtagtgtccgatattgaacaagatcttatcaaagattatccgatgatgcgcttagtgcaaggggatgtaggctcgggaaaaacattggttgccgcattggctgctttaactgcaattgataatggcaaacaagtcgccttaatggcgccaacagaaattcttgcagaacagcatgcgaataattttagacggtggtttgagcctttcggtattgaagttggctggttggcaggtaaagtaaaaggaaaatcaagacaagcagagcttgaaaaaatcaaaactggtgccgtgcaaatggtggtggggacgcatgctttattccaagaagaagtcgagttttccgacttagcattagtgattattgatgaacaacatcgttttggggtgcatcaacgattaatgttgcgtgaaaaaggcgaaaaagcgggatttcatccccatcagttaattatgacggccacaccgattccgagaacgttggcaatgaccgtatatgcagatttggatacatcaattattgatgaattgcctccaggtcgtacgccgataacaaccgtagtggtttctgaagaacgtcgcgctgaaattgtgatgcgtgtaaaaaacgcttgtgttaatgaaaaacgtcaagcctattgggtgtgtacgttaattgatgaatcagaggtgttagaagctcaagcagctgaagcgatttgggaagatttaacgaaagcgttaccgatgttaaatattggtttagtgcacgggcgcatgaaaccccaagaaaaacaagatgtcatgatgcgttttaaaaatgcagaattggatttattggtggcgacgacagtcatcgaagtgggggttgatgttccgaatgcaagtttgatgattatcgaaaatgcagaacgtttaggtttatcgcagcttcatcagttacgagggcgcgtcggtcgaggcagcacggcttctttttgtgtactaatgtataaacctccgctaggtaaagtttcgcaaaagcgtttgcaagtgctaagagatagccaagatgggtttgttatttcggaaaaagatttagaaattcgtgggccaggtgaagtacttggaacgaaacaaacgggaattgctgaattgcgaatagcaaatttaatgcgagatagaaaaatgataccaacggtgcaacattatgcgaaatcacttatccaaaaataccctgatgtggcagaaagcctaatctgtcgctggctcaataataaagaaatttactcgaacgcttaa

SEQ ID NO: 2591 - DNA, 2115 bp, H. influenzae strain 86-028NP
ttggaactgtttgcggatttagatcgaattattcaagggtatttgcccgcagataaaattgaactcatcaagcgtgcgtttgtgattgcaagagatgcgcacgaaggacaatttcgctccagcggcgaaccttacattacccatcctgtggcggtagcctccattattgctcaacttcacttagatcacgaagcggtaatggctgcgcttttgcacgatgttattgaagatacaccttatacggaaaaccaactgaaagaagagttcggtgccagtgtagctgaaattgtggacggtgtatcaaaactcgataagttgaaatttcgtactcgccaagaagcacaagtcgagaattttcgcaaaatgattttggcgatgacgcgcgatattcgtgttgtgttaatcaagcttgctgaccgcacgcataatatgcgcacgcttggttcgttacgaccagataaacgtcgccgtattgcgaaagaaacgcttgaaatctattgtccgcttgctcatcgtttaggtattgagcatatcaaaaatgaattagaagacttatcttttcaagcaatgcatccacatcgttatgaggtgttaaaaaaactcgttgatgtggcacggagtaatcgacaagatttaatcgaacgtatttcacaagagattaaagtgcggttagaaaacgcaggcatttttgcccgagtgtggggacgtgaaaaacatctttataagatctatcaaaaaatgcgtataaaggatcaagaattccactctattatggatatttatgcgttccgtgtgattgtgaaaaatgttgatgattgttatcgcattttggggcaaatgcataatctttataagccacgtccaggccgagttaaggattatatcgccgtacctaaagcaaatggctatcaatctttgcaaacttcaatgattgggccgaaaggagttcccgtagaagttcatatccatactgaggatatggaacaagtcgctgaaatgggcattactgcgcattgggtttataaagaaaatggtaaaaacgatagtacaaccgcacaaatccgcgtacaacgctggttgcaaagtttggtcgaaattcaacaaagtgtaggtaattcgtttgagtttattgagaatgtaaaatcagagtttttcccgaaagaaatttatgtttttacgccaaaaggtcgaattgttgaattaccaatgggcgcaacagcagtagatttcgcttatgctgtgcattcagatgtggggaatacttgtgttggcgtgactgttgagcataaaccttatccactttcaaaagcccttgaatcagggcaaacagtcaatattattactgatccaaatgcgcatcctgaagtcgcatggttaaattttgtggtaacggctcgtgcgaaaacacggattcgccattatctcaaacagcgttgtgaagaggatgcggtgaaattaggcgaagttgagcttaatgtagcattgcagccgcataatttaggtgatttttctattcaacaaattagcactgtattagatgctttagccctttcttctttagatgaattattacgagaaattggtttaggtaatcagtcagcctccatgattgcgcatcaatttgtgggcgtgccgttagaatctgctaatactaagaatctcgaatttgaatcaaaaatactcactattgcaccaatgcaagtgggtaaaacacaatttgcgcaatgttgccatccaatcctaggtgatcctattgtgggatgttgtacagaaaaaaatacagttgtggtacaccatcaacattgtgcaagtttgaaaaatgcttgtcgtcaatcgttggctaaatgggataacgttcaaagtgcggtgaattttgaggctgaattacaaatagaaatattgaatgagcagaatgccttgcttagtttaatgaccgcaatttcagcgagcgaaagcagtctccaaaatatttggacggaagaattagagaacaatttattgcttgtgattttgcaggtttgtgtaaaagatatcaaacaccttgccaatatcgttcatcgtattaaaggcatcactggcgtcgttaatgtcaaacgcaatattaatgagctatga

SEQ ID NO: 2592 - DNA, 267 bp, H. influenzae strain 86-028NP
atggctcgtgttactgtgcaagatgcagtagaaaaaattggtaaccgttttgatttaattttaacggctgcacgtcgtgcaagacaattacaacttaatcaaagtgcaccattagtgccagaagataatgacaaaccaacagtaatcgcattacgtgaaatcgaaaaaggtttgattaatcaagatattatggatgcacaagaattccaaaaaatggcgaaagtgcaagaaacggaagaagcagctgttgcattaattacagaataa

SEQ ID NO: 2593 - DNA, 627 bp, H. influenzae strain 86-028NP
atgtctcaaggtaatctttatattttatctgcaccaagtggcgcaggaaaatcttcattaatttctgcgttattggcatcagatagttcaactcaaaaaatggtttctgtgtcacatacgacccgtgccccacgcccaggtgaagttgaaggcgtacactattattttgtatcaaaagaagagtttgaatcactcattgaacaagatttatttctagaatatgccaaagtttttggtggcaattattatggaacctctttacctgcgattgaagaaaatttagcaaaaggcattgatgtatttttagatattgattggcagggtgcccaacaaatccgtaaaaaagtgccttcagtaaaaagcatttttattttaccgccttcattgcctgaattagagcgtcgtttaattggtcgtgggcaagatagtgaagaggttattgccgaacgaatgtcaaaagcgataagtgaaatttcgcattatgacgaatatgattatgtcattgtgaatgatgattttgagaaaacattaaaagatttacaaagtattttgcaatcggaacgcttaactaaagattatcaacaaaaacaaaatgcaatgttaattcaacagctactagcaaaatag

SEQ ID NO: 2594 - protein, 339 aa, H. influenzae strain 86-028NP
MAIKIGINGFGRIGRIVFRAAQHRDDIEVVGINDLIDVEYMAYMLKYDSTHGRFDGTVEVKDGNLVVNGKTIRVTAERDPANLNWGAIGVDIAVEATGLFLTDETARKHITAGAKKVVLTGPSKDATPMFVRGVNFNAYAGQDIVSNASCTTNCLAPLARVVHETFGIKDGLMTTVHATTATQKTVDGPSAKDWRGGRGASQNIIPSSTGAAKAVGKVLPALNGKLTGMAFRVPTPNVSVVDLTVNLEKPASYDAIKQAIKDAAEGKTFNGELKGVLGYTEDAVVSTDFNGCALTSVFDAEAGIALTDSFVKLVSWYDNETGYSNKVLDLVAHIYNYKG

SEQ ID NO: 2595 - protein, 607 aa, H. influenzae strain 86-028NP
MKSKNRVNMNLDLHFVHRIQQQAKTRANMTALRYKEHGLWRDISWKNFQEQLNQLSRALLTHNIDVQDKIAIFAHNMERWTIADIATLQIRAITVPIYSTNTAQQAEFILNHADVKILFVGDQEQYDQALEIAHHCPKLQKIVAMKSTIQLQQDPLSCTWESFIETGSNAQQDELTQRLNQKQLSDLFTIIYTSGTTGEPKGVMLDYANLAHQLETHDLSLNVTDQDISLSFLPFSHIFERAWAAYILHRGAILCYLEDTNQVRSALTEIRPTLMCAVPRFYEKIYAAVLDKVQKAPKLRQIMFHWTISVGQKHFDLRANNKAIPFLLKKQFALADKLVLSKLRQLLGGRIKMMPCGGAKLEPAIGLFFHAIGINIKLGYGMTETTATVSCWHDFQFNPNSIGTLMPKAEVKIGENNEILVRGKMVMKGYYKKPEETAQAFTKDGFLKTGDAGEFDEQGNLFITDRIKELMKTSNGKYIAPQYIESKIGKDKFIEQIAIIADAKKYVSALIVPCFDSLEEYAKQINIKYHDRLELLKNSDILKMFEQRINAVQKELAHFEQVKKFTLLSQAFSIKLGEITPTLKLRRKVILERYRKQIEAMYHSQEA

SEQ ID NO: 2596 - protein, 262 aa, H. influenzae strain 86-028NP
MMYKAVFSDFDGTLLTSQHTISPRTVAVIKRLTANGIPFVPISARSPLGILPYWKQLETNNVLVAFSGALILNQNLEPIYSVQIDPKDILEINTVLAEHPLLGVNYYTNNDCHARDVENKWVIYECSVTKIEIHPFDEVATSSPHKIQIIGEAEEIIEIEVLLKKKFPHLSICRSHANFLEVMHKNATKGSAVRFLEDYFGVQTNEVIAFGDNFNDLDMLQHAGLGVAMGNAPDEIKQAANVITATNNEDGLALILEEKFPE

SEQ ID NO: 2597 - protein, 154 aa, H. influenzae strain 86-028NP
MGSVLVDLQIATENIEGLPTEEQIVQWATGAVQPEGNEVEMTVRIVDEAESHELNLTYRGKDRPTNVLSFPFECPDEVELPLLGDLVICRQVVEREAAEQEKPLMAHWAHMVVHGCLHLLGYDHIEDDEAEEMESLETQIMQGLGFDDPYLAEK

SEQ ID NO: 2598 - protein, 270 aa, H. influenzae strain 86-028NP
MQCWIRQTINFFRKTKNTEKLTALLQQKEDILAVEMPVSLVYNGISHAVMMCSPNNLEDFALGFSITEGIIDKPEDIYGIDVVEVCNGIEVQIELSSRKFMALKEHRRNLTGRTGCGICGTEQLNQVYKTFPKLDCTFQFDLNLLDSCLIDLQKNQLLGCKTGATHACAFFDLYGNMLAIYEDVGRHVALDKLLGWHAKSGKPRGFILASSRASYEMVQKTVACGVEMLVTISAATDLAVTMAEKHNLTLIGFAREGKGNIYSGHQRLHN

SEQ ID NO: 2599 - protein, 1028 aa, H. influenzae strain 86-028NP
  misc_feature (204)..(204): Xaa = selenocysteine
MQVSRRKFFKICAGGMAGTSAAMLGFAPANVLAAPREYKLLRAFESRNTCTYCAVSCGMLLYSTGKPYNSLSSHTGTNTRSKLFHIEGDPDHPVSRGALCPKGAGSLDYVNSESRSLYPQYRAPGSDKWERISWKDAIKRIARLMKDDRDANFVEKDSNGKTVNRWATTGIMTASAMSNEAALLTQKWIRMLGMVPVCNQANTXHGPTVASLAPSFGRGAMTNNWVDIKNANLIIVQGGNPAEAHPVGFRWAIEAKKNGAKIIVIDPRFNRTASVADLHAPIRSGSDITFLMGVIRYLLETNQIQHEYVKHYTNASFLIDEGFKFEDGLFVGYNEEKRNYDKSKWNYQFDENGHAKRDMTLQHPRCVINILKEHVSRYTPEMVERITGVKQKLFLQICEEIGKTSVPNKTMTHLYALGFTEHSIGTQNIRSMAIIQLLLGNMGMPGGGINALRGHSNVQGTTDMGLLPMSLPGYMRLPNDRDTSYDQYINAITPKDIVPNQVNYYRHTSKFFVSMMKTFYGDNATKENGWGFDFLPKADRLYDPITHVKLMNEGKLHGWILQGFNVLNSLPNKNKTLSGMSKLKYLVVMDPLQTESSEFWKNFGESNDVNPAEIQTEVFRLPTTCFAEEEGSIVNSGRWTQWHWKGCDQPGEALPDVDILSMLREEMHELYKKEGGQGIESFEAMTWNYAQPHSPSAVELAKELNGYALEDLYDPNGNLMYKKGQLLNGFAHLRDDGTTTSGNWLYVGQWTEKGNQTANRDNSDPSGLGCTIGWGFAWPANRRVLYSRASLDINGNPWDKNRQLIKWNGKNWNWFDIADYGTQPPGSDTGPFIMSAEGVGRLFAVDKIANGPMPEHYEPVESPIDTNPFHPNVVTDPTLRIYKEDREFIGSNKEYPFVATTYRLTEHFHSWTAQSALNIIAQPQQFVEIGEKLAAEKGIQKGDMVKITSRRGYIKAVAVVTKRLKDLEIDGRVVHHIGLPIHWNMKALNGKGNRGFSTNTLTPSWGEAITQTPEYKTFLVNIEKVGEA

SEQ ID NO: 2600 - protein, 312 aa, H. influenzae strain 86-028NP
MAGTAQGVQTQDVIKISATSGLTPAPQARDHKVEVAKLIDVSTCIGCKACQVGCSEWNDIRSDINAQCVGVYDNPVDLDAKAWTVMRFNEVEENDRLEWLIRKDGCMHCTEPGCLKACPAPGAIIQYANGIVDFQSDKCIGCGYCIAGCPFNIPRMNPEDNRVYKCTLCVDRVSVGQEPACVKTCPTGAIRFGSKEEMKIYAEQRVADLKSRGYENAGLYDPPGVGGTHVMYVLHHADKPELYNGLPKDPQIDLSVTLWKDVLKPVAAVAMGGLALAEVAHYLTVGPNVEEDVEDHHHEFEENKPSKGENNE

SEQ ID NO: 2601 - protein, 238 aa, H. influenzae strain 86-028NP
MSKIEISNDTRVIRHRTPARISHWMLVICFFMTMFTGVAFFFPDFAWLTEILGTPQIARAIHPFTGILMFFAFIYLALLYWDHNIPEKNDIRWAKGVIEVLKGNEHAVADNGKYNLGQKMLFWTLNLAMVTLLVTGIIMWRQYFSHYFSIPVLRIAILLHSASAFMLFTGILVHIYMAFWVKGSIRGIVEGWVTVRWAKKHHPRWYREEVLSKLEEDLLNEQSGKVGKTKVLFKGFGK

SEQ ID NO: 2602 - protein, 302 aa, H. influenzae strain 86-028NP
MSIKILSESEIKQVANSYQAPAVLFANPKNLYQRRAKRLRDLAQNHPLSDYLLFAADIVESQLSTLEKNPLPPQQLEQLNAIEPLNAKTFKRDSIWREYLTEILDEIKPKANEQIAATIEFLEKASSAELEEMANKLLAQEFNLVSSDKAVFIWAALSLYWLQAAQQIPHNSQVENAENLHHCPVCGSLPVASIVQIGTSQGLRYLHCNLCESEWNLVRAQCTNCNSHDKLEMWSLNEELALVRAETCGSCESYLKMMFQEKDPYVEPVADDLASIFLDIEMEEKGFARSGLNPFIFPAEDA

SEQ ID NO: 2603 - protein, 146 aa, H. influenzae strain 86-028NP
MSIISQIEACDFERLYEIEQQAHLVPWSFGTLKNNQGERYLNLKLIENNQIIGFAICQTVLDEATLFNIAIVPSHQGNGLGKLLLNELIARLKEKGVQTLWLEVRESNPARFLYEKIGFNEVDIRKNYYPKPSGGRENAVVMACYL

SEQ ID NO: 2604 - protein, 134 aa, H. influenzae strain 86-028NP
MNRRDLLLQEMGISQWELYRPEVLQGSVGISVAENIRFITVSNENISSSPLLADVLLSLNLKKENCLCLNYDQIQHMECKQPIRYWLLSENNDQIDRTLPFCKQAEQVYRSPSWQQFQSNHQAKRALWQQIQQP

SEQ ID NO: 2605 - protein, 330 aa, H. influenzae strain 86-028NP
VISLESQVLERHLSFFDGKSVLFAGGISDNFPQTLASKCSSIQIWSCYFDYARTQSAVNFSVEFQGQADLIVYYWTKNKQEVNFQLIQLLAQASIGQEILIIGENRCGVRSVEKTLAPYGEIAKIDSARRCGLYHFSLQNKPHFELKNFWKTYQHPTIQDLTIYSLPGVFSAAELDTGTELLLSTIDNKIKGKVLDLGCGAGVIGSVIKKSSTNAQITMTDIHAMALESAHKTLSENQLQGEVYASDVFSDIEGKFDLIISNPPFHDGIDTAYRAVTELITQAKWHLNQGGELRIVANAFLPYPELLRQHFGDYEILAQTGKFKVYSVKN

SEQ ID NO: 2606 - protein, 302 aa, H. influenzae strain 86-028NP
MTEQFDKTYCGFIAIVGRPNVGKSTLLNKILGQKISITSRKAQTTRHRIVGIKTEGAYQEIYVDTPGLHIEEKRAINRLMNRAASSAIGDVDLIIFVVDGTHWNADDEMVLNKLRNAKAPVVLAINKVDNIKNKDDLLPFITDLSSKFNFAHIVPISAQRGNNVHELEKIVRQSLREGVHHFPEDYVTDRSQRFMASEIIREKLMRFTGEELPYSVTVEIEQFKVNERGTYEINGLILVEREGQKKMVIGAGGQKIKTIGMEARADMERLFDNKVHLELWVKVKSGWADDERALRSLGYMDE

SEQ ID NO: 2607 - protein, 227 aa, H. influenzae strain 86-028NP
MNHLDRLERKIGYCFNDIALLKQALTHRSAATQHNERLEFLGDSILNFTIAEALYHQFPRCNEGELSRMRATLVREPTLAILARQFELGDYMSLGSGELKNGGFRRESILADCVEAIIGAMSLDQGLAVTTQVIRNWYQQLLAEIKPGDNQKDAKTRLQEYLQGKHLPLPTYEVVNIQGEAHCQIFTVECKVKSAGKIDRTFVAKGSSRRKAEQAAAEQILKELDIK

SEQ ID NO: 2608 - protein, 349 aa, H. influenzae strain 86-028NP
MSNLFFVILLAVGFGVWKVLDYFQLPNTFSILLLILTALSGVLWCYHRFVVLPKRHRQVARAEQRSGKTLSEEEKAKIEPISEASEFLSSLFPVLAVVFLVRSFLFEPFQIPSGSMESTLRVGDFLVVNKYAYGVKDPIFQNTIIEGEKPQRGDVIVFKAPQQALIRTGLGATRAAFAENLALSSKDNMSGVDYIKRIVGKGGDRIIFDVEQKTLKIVYGKDGKPCEVDCETKAFEYTQNPTNPAFPNELELTEKGDVTHNVLIGEYRRYSDLEFFPQEGMQTAEWLVPEGQYFVMGDHRDHSDDSRFWGFVPEKNIVGKATYIWMSLEKEANEWPTGFRFDRFFTAIK

SEQ ID NO: 2609 - protein, 598 aa, H. influenzae strain 86-028NP
MKNIRNFSIIAHIDHGKSTLSDRLIQTCGGLSDREMEAQVLDSMDLERERGITIKAQSVTLNYKAKDGETYQLNFIDTPGHVDFSYEVSRSLAACEGALLVVDAGQGVEAQTLANCYTAIEMDLEVVPILNKIDLPAADPERVAEEIEDIVGIDAMEAVRCSAKTGVGIEDVLEEIVAKIPAPEGDPNAPLQALIIDSWFDNYLGVVSLVRIKNGVLRKGDKIKVMSTGQTYNVDRLGIFTPKQEDTTVLECGEVGWVVCAIKDILGAPVGDTLTHQHNSATEVLPGFKKVKPQVYAGLFPVSSDDYEAFRDALGKLSLNDASLFYEPETSTALGFGFRCGFLGLLHMEIIQERLEREYDLDLITTAPTVIYEVQLTNGEVVYVDSPAKLPPLNNIAEIREPIAECNMLVPQEYLGNVITLCVEKRGVQTNMVYHGNQIALTYEIPMGEVVLDFFDRLKSTSRGYASLDYGFKRFQAADMVRVDIMINSERVDALALIVHKDNSQYRGRELVEKMRELIPRQQFDIAIQAAIGNHIIARSTVKQLRKNVLAKCYGGDVSRKKKLLQKQKEGKKRMKSLGNVEVPQEAFLAILHVGKDK

SEQ ID NO: 2610 - protein, 127 aa, H. influenzae strain 86-028NP
MIKGIQITQAANDNLLNSFWLLDSEKNEVRCLCAKGEFAEDQVVAVSELGQIEYRELPVNVAPTVKVEGGQHLNVNVLRRETLEDAVNNPDKYPQLTIRVSGYAVRFNSLTPEQQRDVITRTFTESL

SEQ ID NO: 2611 - protein, 219 aa, H. influenzae strain 86-028NP
MKNWTDVIGKEKEQPYFQHALQQVHLARANGKTIYPPQEEVFNAFKYTAFEDVKVVILGQDPYHGANQAHGLAFSVKPEVAIPPSLLNMYKELTQDISGFQMPSNGYLVKWAEQGVLLLNTVLTVERGMAHSHANLGWERFTDKVIAVLNEHREKLVFLLWGSHAQKKGQIIDRTRHLVLTAPHPSPLSAHRGFFGCHHFSKTNSYLESNGMKPIDWQI

SEQ ID NO: 2612 - protein, 474 aa, H. influenzae strain 86-028NP
MTQKLHIKTWGCQMNEYDSSKMADLLLSTHGLELTEAPEEADVLLLNTCSIREKAQEKVFHQLGRWKELKKNNPNLVIGVGGCVASQEGEHIRHRAPYVDIIFGPQTLHRLPEMINQIRGGKSSVVDVSFPEIEKFDRLPEPRAEGPTAFVSIMEGCNKYCTFCVVPYTRGEEVSRPVDDVLFEIAQLAEQGVREVNLLGQNVNAYRGPTHDGQICSFAELLRLVASIDGIDRLRFTTSHPIEFTNDIIDVYRDTPELVSFLHLPVQAGSDRVLTMMKRGHTALEYKSIIRKLRAVRPDIQISSDFIVGFPGETAEDFEQTMNLIAQVNFDMSFSFVYSARPGTPAADMPDDVTEDEKKQRLYVLQERINQQAAQFSRRMLGTEQRVLVEGPSKKDIMELTGRTETNRIVNFQGSPEMIGKFVDVKITDVYTNSLRGEVVRTEDEMGLRIAQSPQEVMNRTRKEDELGVGRYHG

SEQ ID NO: 2613 - protein, 479 aa, H. influenzae strain 86-028NP
MALSKNTKLVILMAIPLITFLLPAPDGLSLIAWRLLGVYIATIVGLVLKPYGEPVILLAAIAVSGVIIGNTEGAKELVKVGNMLDGYKSGTTWLIFTAFTLSSAFVITGLGKRIAYHMIGAMGSTTLRLGYVTMFLDLLLSPATPSNTARSGGIIFPIINSVVVALGSDPEKSPKKAGRYLMMNVYMVVKTTSYIFLTAMAPNALALSLMAPILGFETTWIKWFLAASVPGLLCLFLIPLICYWVSPPELKKVDNKAIAKKGLEELGPMSFREKALSVLFVIALFGWIFSNSLHINATIVAIIVMVLCIVLSIVTWDDILKSKGAWNTLVWYGGIIGMSGLLEKSGFFKWLANTLSTILQFEGHGMMALIVILTLSVSVRYLFASGGAYVAAMVPVFATVGHVTGAPTELLALGLVFANSYGGSVTHYGGGPGPIAFGAGYNDIKSWWITGAIIAFGSLIIHLTIGMAWWKLLMSLGWL

SEQ ID NO: 2614 - protein, 465 aa, H. influenzae strain 86-028NP
LQHFFTTFSTKGSEISLEALLNAREERAILQQQLITQYGQTLLCITLTAVGGVKKNALLDYVFRKALENLTALFTQLNITAVKEIIRPLETGHEAYFVLPIDARTLKVLMIELEESIPLARLWDLDVFNAKGNLLSRTDFDLSPRTCLVCGENAKICARTRKHEIDEIVDKIQSLAQKHDFAEHIGEQVYLALIQEARLSPKPGLVDAINNGSHKDMNLHTFEQSAISLKPFFTQFVLKGMMTAHLSENQILAEIRPLGLLAEKAMFKVTDGVNTHKGAIFSFGLVCTAIGRLLAQKSLVQSAVDFDVKLICSLVAQFTQGLTDELKNYPEHLPSTAGVRLFQKYGLTGVRGEAENGFNLIQTLLPQFDEYHQLEWEHRLLILLLNLMAINSDTNVVHRGGLAGLHFIQQTAQDLLTDQHLVTDKTALTQALMKFDTACIERNLSSGGSADLLALTIFFLSFRGN

SEQ ID NO: 2615 - protein, 500 aa, H. influenzae strain 86-028NP
MTTREQRIEKYHADRSVYQAVPKSESLSRTAKDRKLCTSLEEAIKRSGLKDGMTVSFHHAFRGGDFVVNMVMNKIAEMGFKNLTLASSSLIDSHFPIVEYIKNGVVTKIYSSGLRGELAEQISRGLLNEPVNIHSHGGRVHLVKSGELKIDVAFLGVPCCDTFGNANGFTGKSKCGSLGYARVDAEYADQVVLLTEEFVEYPHYPISIAQDQVDLIVQVEAVGDPKKIGGGATRMTTNPRELLIARKCAEVIFASGYFKDGFSLQTGSGGAALAVTRFLEEKMRRENITADFALGGITASMVALHETGLIKKLLDVQSFDSVAAESLARNPNHIEVSANQYANYSSKGASVERLDMVILSALEIDTKFNVNVLTGSDGVIRGASGGHCDTAASAQVAIIVAPLVRGRIPTVVENVITCVTPGENVDILVTDHGVAVNPKRPDLIEALSKTDIPLFTIEQLCERAYSITGKPKEIEFTNKPVAVVRYRDGSVIDTVYQVKD

SEQ ID NO: 2616 - protein, 291 aa, H. influenzae strain 86-028NP
MKLRRSMLFVPGSNAAMLSNSFIYKPDSIMFDLEDAVALKEKDSARLLVAHALQHPLYKEIETVVRVNPLDSEFGLLDLNSVVRAGVDVVRMPKTESAQDVLDMDHAITEIEKACGREAGSTKMLAAIESPLGITQANQIAFASKRLIGIALGAEDYVRNLKTERSPEGIELLFARCSILQAARAAGIQAFDTVYSNANNEEGFLKEAALIKQLGFDGKSLINPRQIELLHNLFAPTQKDVEQAKRIIEAAAEAERQGAGVVSLNGKMIDAPIIDRAKLVLERAKSGIREE

SEQ ID NO: 2617 - protein, 95 aa, H. influenzae strain 86-028NP
MKITKVAVAGTLESSDVQVRVQPFDSLDIEINSSVAKQFGEQIEATVREVLAKLGITAAQVIVEDKGALDCVLQARVKAAAMRATDETINWEAVL

SEQ ID NO: 2618 - protein, 335 aa, H. influenzae strain 86-028NP
MQFERISTEQKKLSLIQTFLHQNALKLDEQIEYFVVGYNDNEQIVVCGGLAGNIIKCVAIDESLRGSGVALQLITELVDLAYTLKRPHLFIYTKPEYATLFKSCGFYIISDANPYVVLLENSATRLQKQCSLWEKMRVDGNRIGSIVMNANPFTLGHRYLIEQALQQCDHLHLFIVGEDASQFSYTERFEMIQQGIFDLSNITLHSGSDYIISRATFPNYFLKDQLITDESYFEIDLKLFRLHIAQALGITHRFVGTELNCPITAEYNRQMHYWLMDAEMNAPKINVIEIPRKTASNHIISASTVRKHLAEKNWAQLAEFVPMTTLNYLQKCGRF

SEQ ID NO: 2619 - protein, 320 aa, H. influenzae strain 86-028NP
MSTPFKMERGVKYRDAAKTSIIPVKNIDPNQELLKKPEWMKIKLPASSAKIESIKNGMRRHGLHSVCEEASCPNLHECFNHGTATFMILGAICTRRCPFCDVAHGKPLPPDPEEPQKLAETIQDMKLKYVVITSVDRDDLPDRGAGHFSECVKAVRELNPNIKIEILVPDFRGRITQALEKLKDNPPDVFNHNLENVPRLYKEIRPGADYEWSLKLLREFKEIFPNIPTKSGLMVGLGETNEEILQVMQDLRDNGVTMLTLGQYLQPSRHHLPVARYVPPTEFDEFRDKANEMGFEHAACGPFVRSSYHADLQASGGLVK

SEQ ID NO: 2620 - protein, 212 aa, H. influenzae strain 86-028NP
MNNSLIVRQLGLQDYQEIWHKMQDFTDTRNAETQDEIWLVQHYPVFTQGQAGKPEHLLQRSEIPVVQSDRGGQITYHAPGQQVMYVLIDIKRHKNLNVRQLVTALEQTVVKTLAEYGIESYPKPDAPGVYVDGKKICSLGLRIRRGCSFHGLALNINMDLNPFHYINPCGYAGLEMCQLADFVNQDEADCDNVSAKLIKHFADLLGYNITTL

SEQ ID NO: 2621 - protein, 92 aa, H. influenzae strain 86-028NP
MTIENDYAKLKELMEFPAKMTFKVAGINREGLAQDLIQVVQKYIKGDYIPKEKRSSKGTYNSVSIDIIAENFDQVETLYKELAKVEGVKMVI

SEQ ID NO: 2622 - protein, 393 aa, H. influenzae strain 86-028NP
MLKRTTKIAFLSSFVALSAFSVSAEDMQFGVTPPQITAQTYVLMDYNSGAILTALNPDQRQYPASLTKMMTSYVVGVALKQGKIHNTDMVTIGESAWGRNFPDSSKMFLDLNTQVSVADLNRGVIVVSGNDATVALAEHISGNVPNFVETMNKYVQQFGLKNTNFTTPHGLDDPNQYSSARDMAIIGAHIIRDLPEEYKIYSEKDFTFNKIKQANRNGLLWDKTINVDGMKTGHTSQAGYNLVASATTSNNMRLISVVMGVPTYKGREVESKKLLQWGFANFETFKTLEAGKEISEQRVYYGDKNSVKLGALMDHFITIPKGKQSEVKARYELADKNLQAPLAKGQVIGKVVYQLDGKDIASANLQVMNDVGEAGIFGKLWDWLVLTVKGLFS

SEQ ID NO: 2623 - protein, 287 aa, H. influenzae strain 86-028NP
MKLKTGLNLTALLLFMISVAFPAQADTQKMYGIRGDNLSIATQMPAPRTYSVKGQTYTTKSGNEAKSYIKEGLASYYHLKFDGRKTASGDVYNSKQFTAAHKTLPINSYALVTNLHNNRKVIVRINDRGPFSDKRLIDLSHAAAKEIGLISRGIGQVRIEALHVAKNGNLSGAATKTLAKQAKTQEAADRLVLKSNTLFDNASKSINALKGTEFYCLKMLELTSHSQANKLITQLALANIQTEVNRSGNKYEIYIGPFDDKTKMAQVRTKLQKMANNKPLIVYTYKN

SEQ ID NO: 2624 - protein, 371 aa, H. influenzae strain 86-028NP
MEDKIPFWLRVWQRLHIDFWLFIGLLAITAYGMLVLYSASGASEMMFNNRIIQVLLGFIVMLLMAQFPPRFYQRIAPYLYLIGFVLLILVDAIGTTSKGAQRWLDLGFIRFQPSEIVKLAVPLMVAVYLGNRPLPPKLSETFIAIAMILLPTLLVAIQPDLGTAILVSASGLFVVFLAGMSWWLILAAVIGLAGFIPIMWLYLMHDYQRTRVLTLLDPEKDPLGAGYHILQSKIAIGSGGLSGKGWMQGTQSQLEFLPEPHTDFIFAVMGEEHGMIGFLILMAIYLFIIVRGLMIAVNAQTSFGRILAGATTLIFFVYVFVNIGMVSGILPVVGVPLPLFSYGGTSYVAIMASFGLLMSIHTHKSQFMKRS

SEQ ID NO: 2625 - protein, 651 aa, H. influenzae strain 86-028NP
MNLKKFFNTPTHEPFRDKKAERNLFARRTLVAFLGILLLTGVLFTNIYQLQIVNFDTYRTRSNGNRIKLLPLPPTRGLIYDRYGKLLAENLTFFGLYIVPEKTENLDRTLDELRYIVGLTDNDIEHFKKERLRGTRYTPILLKPNLTEEQISRFAVNGYQYPSLEVRPYFKRHYLYGETMAHILGYVGKMNDKDVERLKREDKFANYAGTNDIGKLGIERYYEDILQGTTGFEEVEINNRGKVIRTLRSRPAVAGKSIHLTIDLALQRYITELLSGLKGAVVVLDPKDSSVLAMVSTPSYDNNLFVDGISSEDYKRLLNDPARPLYSRATQGAYPPASTVKPFIAVAAQTENVITPNTTIFDPGYWVLPNSTKRFRDWKKTGHGDTDLNKAITESSDTYFYQVAYNMGIDRLSNWMKDFGFGMPTGIEIQEETAANMPTREWKQKRYKRPWVQGDTISVGIGQGYWTATPLQVAKATTILVNNGKVNTPHLMKAIEGAVLEPYEDPLIYPDISTPKVTAWEAAKRGMYNVVNAANGTGRKAFADANYRVAGKSGTAQVFSLKENEKYNAVGLKKELHDHAWFTAYAPYENPRLVVTVILENAGGGSSNAAPLARKVMDYYLNQRLPQVEKYNVPIQQKKDLSQESEQINGR

SEQ ID NO: 2626 - protein, 155 aa, H. influenzae strain 86-028NP
VKITLIAVGTKMPSWVTTGFEEYQRRFPKDMPFELIEIPAGKRGKNADIKRILEQEGKAMLAACGKGKVVTLDIPGKPWTTPQLAEQLEAWKNDGCDVCLLIGGPEGLSPECKAAAEQSWSLSPLTLPHPLVRVVVAESLYRAWSLTTNHPYHRE

SEQ ID NO: 2627 - protein, 102 aa, H. influenzae strain 86-028NP
MALVEFLMETLDGLKGTDIVHFDVRGKSSITDNMIICTGTSSRQVSAMADNLITECKKAGFETFGEEGKNTADWIVVDLGQAIVHIMQRDAREMYQLEKLWA

SEQ ID NO: 2628 - protein, 551 aa, H. influenzae strain 86-028NP
MSDIAITISLLALVAVIGLWIGHWKIRGVGLGIGGVLFGGIIVAHFTNQYGLKLDAHTLHFVQEFGLILFVYTIGIQVGPGFFSSLRKSGLKLNAFAILIIVLGSIAVVLVHKIADVPLDIALGIYSGAVTNTPALGAGQQILAELGVPQTTVTMGVSYAMAYPFGICGILLAMWLIRLFFKVKVDDEAARFNAESSQDKESLHNISLKVTNQNLDGLTLIQIPGFSDEEVVCSRLKRDDMEIVPKASTEIRINDILQLVGDDNSLAKMRLIIGYEVDAPTVAYSGEIRSERVVVTNEKVLGKKIRALGIHQKYGVVISRLNRAGIELVPTGNTTLQFGDVLHMVGRSDVLNQAISVIGNAQQKLLQVQMLPVFIGIGLGVLVGSIPFYIPGFPVALKLGLAGGPLVVALILARIGTIGKLYWFMPPSANLALREIGIVLFLAVVGLKSGGSFFDTLVNGSGLEWMGYGIFITFIPLMITGILARLYGKLNYLTICGLLAGSMTDPPALAFANEIKEDNGAAALSYATVYPLVMFLRIMSPQLLAVLLWAA

SEQ ID NO: 2629 - protein, 592 aa, H. influenzae strain 86-028NP
MDYSQEAITSLIWILQTLAITSVVFSFGIFLLVRFTQWGRQFWMFAGGYLSPKRSIKPILFFLLIVAMTLLSVRISLVHSEWYKNMYTSLQEFNEHVFWQQMGLFCVIAASSVSAALVSYYLEQRFVINWIEWLNEQLVDKWMAHRAYYKTQYLSENLDNPDQRIQQDVQSYVKTTLSLSTGVIDAVTSMISYTILLWGLAGPMMVLGVEIPHMMVFLVFGYVIFTTLIAFWLGRPLISLNFINELLNANYRYSLIRIKEYAESIAFYAGEKVEKNQLYQQFNAVIHNMWIIVFRTLKFSGFNLVVSQISVVFPLLIQVGRYFEKQIKLGDLMQTLQVFGQLHANLSFFRNTYDNFASYKATLDRLTGFCYAIEKANNKSQTQIHNHPTDVIFKNLSIQNPLGHTLIKHLNITLPQGTSLLIQGKSGAGKTTLLRTIAGLWSYAEGEINCPTHNQLFLSQKPYVPQGNLMSALAYPNNADNISHTQAVEILNKVQLGHLAEQLEKEQDWTRILSLGEQQRLAFARLILHKPAVAFLDEATASMDEGLEFSMYQLLQQELPQTTIISVGHRSTLKTLHQQQLILQDKGQWQVL

SEQ ID NO: 2630 - protein, 378 aa, H. influenzae strain 86-028NP
VQFFVCLTKSFSIFCQTKLTFILNGIIMLFKKIRGLFSNDLSIDLGTANTLIYVKRQGIVLDEPSVVAIRQDRVGTLKSIAAVGKEAKLMLGRTPKSIVAIRPMKDGVIADFFVTEKMLQYFIKQVHSGNFMRPSPRVLVCVPAGATQVERRAIKESAIGAGAREVYLIEEPMAAAIGAKLPVSTAVGSMVIDIGGGTTEVAVISLNGIVYSSSVRIGGDRFDEAIISYVRRTFGSVIGEPTAERIKQEIGSAYIQEGDEIKEMEVHGHNLAEGAPRSFTLTSRDVLEAIQQPLNGIVAAVRTALEECQPEHAADIFERGMVLTGGGALLRNIDILLSKESGVPVIIAEDPLTCVARGGGEALEMIDMHGGDIFSDEI

SEQ ID NO: 2631 - protein, 351 aa, H. influenzae strain 86-028NP
MKPIFGKAPPLGIRLLIAIFASIALILADGRNSSITKARSAMETAIGGLYYLANSPRSILDGISENLVDTNKLQIENKVLRQQLLEKNADLLLLDQLKVENQRLRLLLNSPLRTDEYKKIAEVLTAETDIYRQQIVINQGKKDGAYVGQPVIDEKGVIGQIISVGENTSRVLLLTDVTHSIPVQVLRNDVRVIASGTGHTDELSLDNVPRSVDIEKGDLLVTSGLGGRFLEGYPVAVVQSVSRDSSNYFAIVKAKPLALLERLRYVLLLWPSNLDISKVKSMSPEEVRNLVQKRLESQANEANYRVKKTPLTEKDFLENEEKTIIEPDIPTDFLQNEEDLPIEQQEERIED

SEQ ID NO: 2632 - protein, 162 aa, H. influenzae strain 86-028NP
MQTRFILQWFTILSFFVIAFVLELAPWPVGFQMLKPAWLVLVLLYWVLAIPNKVSIGWSFLLGLTWDLILGSTLGVHALVLSTSMYIIAKNYLILRNLSLWFQSLLVVLFVFIIRLLIFLVEFSLHTAFFHWQAILGAFASGLLWPWVFLLMRKIRRKVKLH

SEQ ID NO: 2633 - protein, 258 aa, H. influenzae strain 86-028NP
MDMANWQNYRSTVNGMPAVFTANIEDVEKYHGKGLDKIVQFTIDYQADDETGLPSEVEYDKLINRVFKILTQLTALPNVFFAGHFICNSQIKIHFYCKHENLIVETLQQIDFVKDINVQKDLIWDTYFDFLLASPLEIKLNATEELLDLLKSKGRNLSDTYLVEHSFHFDEEQKMFPFMDELSLGDYSFTTLQYSAQAIQFNEDDEPYFLVKLEQEISLENSEIFEQVERFEKLAEQFSGEYIGWECDSLLDSNKPLN

SEQ ID NO: 2634 - protein, 267 aa, H. influenzae strain 86-028NP
MKFISFNINGLRARPHQLEAIIEKYQPDVIGLQEIKVADEAFPYEITENLGYHVFHHGQKGHYGVALLTKQEPKVIRRGFPTDNEDAQKRIIMADLETEFGLLTVINGYFPQGESRAHETKFPAKEKFYADLQQYLEKEHDRSNPILIMGDMNISPSDLDIGIGDENRKRWLRTGKCSFLPEERAWYQRLYDYGLEDSFRKLNPTANDKFSWFDYRSKGFDDNRGLRIDHILISQKLAERCVDVGIALDIRAMEKPSDHAPIWAEFK

SEQ ID NO: 2635 - protein, 224 aa, H. influenzae strain 86-028NP
MEIEVVYQHSDFIIINKSEGISVHKDQEEQGLTELVAKQLNVPKVWLVHRLDKVTSGLLILALNAESAAEFSRLFSEHKIHKTYLALSNQKPKKKQGLIIGDMKKSREGAWKLCQTKENPAITRFASVSCEPNLRLFILKPQTGKTHQLRVAMKSLGSPILGDGLYGKNTEKIDRTYLHATQLEFDYLNDFISVTCLPSQGQFWIKPTVFEQIQVYLTKPFLSK

SEQ ID NO: 2636 - protein, 354 aa, H. influenzae strain 86-028NP
MEKQIFEHSVNVEEEHYQPKQEFHNMEAKLDEALDGELLDAQLEQALKPKSSFRKTLLKFTALLFGLATVAQSMQWIWDSYQQHQWIYLAFALVSLIIILLGIKEIIGEWRRLVRLKKREQWQQQSQQIWLESAVKNGDVFSVHNAEKSKILCLDIAESLGLENDSPAVIQWQHQLNEAYSAQEIAHLFSRHVLSSFDAQAKKLISKMAAESAVIVAISPLAVVDMFFIAWRNLRLMNKIAEIYGIELGYFSRIRLLRMVLVNIAFAGATEVAQDIGMDWLSQDVTAKLSTRIAQGIGVGLLTARLGVKAMELCRPLAFQLNEKPKLSHIQQELLSSVKDIVLGKNKIYKKEQI

SEQ ID NO: 2637 - protein, 220 aa, H. influenzae strain 86-028NP
MQSRLIVDAQKESLLSTHKVLRNTYFLLGLTMAFSAVVAFISMSLNLPYPNIIVLLVGFYGLLFLTNKLADRPAGILAAFAFTGFMGYTIGPILNMYVARGMEDLIMLAFAGTAIVFFACSAYVLTTKKDMSFLSSAMFALFIVLLLGMVASFFFQIPALSVAISALFVVFSTMTILYETSNIIHGGETNYIRATVNIYVSIYNLFLSLLRLLSIFSSDE

SEQ ID NO: 2638 - protein, 184 aa, H. influenzae strain 86-028NP
MKKQILALVCGVMFSSSTWAHNLQLEQSLPAVQVTEYGEIVLSGKDTAFQPWGSAELAGKVRVVHHLAGRTAAKEKNQSMIDAIKASHFNPVKYQTTTIINADDAIVGTGMFVKNSAQKGKQENPHSQVVLDDKSAVKNAWGLNSKDSAIIVLDKTGKVKFVKEGKLFDSDIQTVISLVNGLTK

SEQ ID NO: 2639 - protein, 120 aa, H. influenzae strain 86-028NP
VRLLYVIKKENPMDQMPNCPKCQSEYVYHDSINFVCPDCGNEWDNNEIQESDDDQLIVKDSNGNLLAEGDNVLLIKDLKLKGSSEVLKKGTKFKNIRLVNGDHNVDCGKIMLKSEFLKKA

SEQ ID NO: 2640 - protein, 212 aa, H. influenzae strain 86-028NP
MSYTTQQIIEKLRELKIVPVIALDNADDILPLADTLAKNGLPVAEITFRSEAAADAIRLLRANRPDFLIAAGTVLTAEQVVLAKSSGADFVVTPGFNPKIVKLCQDLNFPITPGVNNPMAIEIALEMGISAVKFFPAEASGGVKMIKALLGPYAQLQIMPTGGIGLHNIRDYLAIPNIVACGGSWFVEKKLIQSKNWDEIGRLVREVIEIIK

SEQ ID NO: 2641 - protein, 467 aa, H. influenzae strain 86-028NP
MKQFMDENFLLSTDTAKILYHDYAKNKPIFDYHCHLNPREVAENRQFNDLAEIWLEGDHYKWRALRTAGVPEELITGKATNYQKYLAWAKTVPLCIGNPIYHWTHLELRRPFGITNMLFNPQNAEKIWHQCNEMLQQPEFSARGIMQKMNVKLVGTTDDPIDSLQYHQAIKNDESFDIDVVPSWRPDKVFKIELPQFNDYLVQLSEIADVDIYTFADLKKALLKRLEYFDAQGCKSADHGMEIVRFSAIPDESVLNSILQKRLQNQPLLEEEVAQFSTAILVWLASEYCKRHWVMQMHIGAIRNNNSRMFALLGADSGFDSIGDRTYAYPLSRLLDAMDKENQLPKTILYCLNPRDNEMIASMIGNFQGDGIAGKIQFGSGWWFNDQKDGMERQLQQLSQLGLLSQFVGMLTDSRSFLSYTRHEYFRRILCEMIGGWVEKGEAPNDISLLGKMIEDICFNNAKNYFK

SEQ ID NO: 2642 - protein, 285 aa, H. influenzae strain 86-028NP
MEFTMNIAANHNLENKLIIITGAGGVLCSFLAKQLAYTKANIALLDLNFEAADKAAKEINQSGGKAKAYKTNVLELENIKEVRDQIAIDFGTCDILINGAGGNNPKATTDNEFHQFDLNETTRTFFDLDKSGIEFVFNLNYLGSLLPTQVFSKDMLGKQGANIINISSMNAFTPLTKIPAYSGAKAAISNFTQWLAVYFSKVGIRCNAIAPGFLVSNQNRTLLFDTEGKPTDRANKILTNTPMGRFGESEELLGALLFLIDENYSAFVNGVVLPVDGGFSAYSGV

SEQ ID NO: 2643 - protein, 423 aa, H. influenzae strain 86-028NP
MLLLFLCSLFLLLFLGVPVALSMLLSASIMLYHLDMFDTQLITENFVMGTNNFPLMAIPFFMLTGEIMKHGGISERIINFATSMVGHIKGGLGYVAIISGLIFAGLSGSAVADTAALGAILIPMMISKKYDGARSTGLICAAGIISVVIPPSIPMIIYGITAGASITKLFMGGTVPGLLMVVGLWVTWKILYRNNDTSLERKQTGKERWVAFKKAFWPLLLPIIIIVGLRGGIFTPTEAGVVAAIYAGIVSIAYKGLTFSKLKDVFIGTIKTTSMVMFVAASAMISAFAITVAQIPTELVQTIKGLTDSPTILMFIIMLFLLLVGCVMDLIPAVLIFVPVLLPVLRAYNIDIAYFGIMMVINLSIGLITPPVGTVLYVGSGISKLGIGALSKGIAPFLFVYAIIMMLIVFFPEIVIVPMNWLS

SEQ ID NO: 2644 - protein, 165 aa, H. influenzae strain 86-028NP
MGDKEGACFMKIAKYLDKALEYLSILALVIMISLVFFNSVLRYFFDSGIAFSEEFSRICFVYMIFFGIILVAKDKAHLTVEIIISALPEQYRKIVLIVANICVLIAMIFIAYGALQLMSLTYTQQMPATGISSSFLYLAAVISAVSYFFIVMFSMIKDYKESSDK

SEQ ID NO: 2645 - protein, 328 aa, H. influenzae strain 86-028NP
MKSIKSLGKLLLASSILFSSSAFGKTIIKLGHYNSDIHPSHIALQEYFKKTIENETNHRYEIRLYPNNQLGGEDQIVNGLRNGTIEAGITGLLLQNVDPIFGVWEWPYLFKDNQEAKKVLESPIANKIGQKMEKYGIKLLAYGMNGFRVISSNKKLEKFDDFKGLRLRVPLNSLFVDWAKAMNINPQSMPLSEVFTALEQKVIDGQENPYMLIKDSGLYEVQKYIIQSNHIFSPGLLQISLKTWNKIPKEDQIIFEKAAKLYQEKEWELAIKTELEVKDYLAKHGNEIIVPSEAFKNDMVNASKVLYDSFYKKYDWAKDVVQKINEAK

SEQ ID NO: 2646 - protein, 342 aa, H. influenzae strain 86-028NP
MKERIKAICLEKPNNVVVKEVPYPEKSDNDVLIQVESMGICGSDIGAYRGTNPLVTYPRILGHEIVGRVIESGIGMPDRVRVGDRVIVDPYVFCGQCYPCSIGRTNCCESLKVIGVHIDGGMQEVIRHPAHLLTKVPDNLPIHQLPLAEPLTIALHALHRTTLKSGEHIVIIGAGAIGLMAALAAVQYGAIPILVDILEQRLEYAKSLGIEHIVNPHKEDDIKRIKEITSGRMAEVVMEASGANISIKNTLHYTSFAGRIALTGWPKTETPLPTNLITFKELNIYGSRTSKGEFEEALDMLATNKINASHIITKCIKFEEIPSFISDLSDHPENYLKINAVF

SEQ ID NO: 2647 - protein, 266 aa, H. influenzae strain 86-028NP
VSRITKIKNWNTNLRKNMENIVNRTYTRIGQLLKQDISQGIYSIGDKLPTEREISEKFGVSRTIVREAMVMLEVEKLVEVKKGSGVYVVRTPESIHMEHSDLPDVGPFELLQARQLLESSIAEFAALQATKKDILNLKQILNREKELLTQNQDDYSADKDFHLALAEITQNDVLVKLQEQLWQYRFNSAMWAQLHSRILQNDYHHLWIEDHQTILSAIQKKNANEARKAMWQHLENVKVKLFELSDVEDPHFDGYLFNTNPVVVGI

SEQ ID NO: 2648 - protein, 394 aa, H. influenzae strain 86-028NP; identical to SEQ ID NO: 628

SEQ ID NO: 2649 - protein, 237 aa, H. influenzae strain 86-028NP
MFEWITDPEAWVSLATLTALEIILGVDNIIFISILVGRLPESQRQSGRIIGLGLAMLTRILLLMSLAWIMKLTAPLFTLFNQAISGRDLILLIGGLFLIIKSFGEIKEAINHQEHHNSESKNKVSYFGVLIQIAVLDIVFSLDSVITAVGMASHLPVMILAIIIAVGVMMFAAKPIGAFVDTHPTLKILALAFLVLVGISLIAESLDIHIPKGYIYFAMGFSVVVEMINIRMRRLIK

SEQ ID NO: 2650 - protein, 609 aa, H. influenzae strain 86-028NP
MFDAKKFLADVSHEPGVYRMYDDKDQVIYVGKAKDLKKRLSSYFRKNLSSKKTEALVASIHHIDTMLTSSETEALLLEHNFIKLYQPRYNVLLRDDKSYPFILLTKERHPRITSYRGSKKFAGEYFGPYPHAGAVRETLSLLQKLFPVRQCENSVYSNRSRPCLQYQIGRCSAPCVQGYVSDEEYNQQVELARLFLQGKDQQVLDYLIGKMEQASRNLDFEQAARYRDQIQAVRSVIEKQFVSNERLDDMDIMSIAYQHGLACVQVMFIRQGKVLGNRSYFPKVPANTDLSELTETFVGQFYLQGHQGRSIPNSIIVDRQLAEKSELEQLLTEQAGRKVTIQESVKGDKSKYLQLAQVNAKAALNVQLKQSSRMSERYQALCDLLNLPEIKRMECFDISHTMGNQTVASCVVFNQEGPLKSDYRRFNIEGITGGDDYAAMEQALQKRYERDLEEDKIPDIIFIDGGKGQLNRALNVFQHLQVKWDKNRPHLIGVAKGVDRRAGQEVLIISKQDREIHLPDDSLALHLIQHIRDESHNHAISGHRKKRQKAFTQSGLETIEGVGAKRRQALLKYLGGLQGVKKATLDEIASVPGISLKLAETIFETLKND

SEQ ID NO: 2651 - protein, 254 aa, H. influenzae strain 86-028NP
MSFTVIIPARFASSRLPGKPLADIAGKPMIQHVFEKALQSGANRVIIATDNENVADVAKNFGAEVCMTSVNHNSGTERLAEVVEKLAIPDNEIIVNIQGDEPLIPPVIVRQVADNLAKFNVNMASLAVKIHDAEELFNPNAVKVLTDKDGYVLYFSRSVIPYDRDQFMNLQDVQKVQLADAYLRHIGIYAYRAGFIKQYVQWAPTQLENLEKLEQLRVLYNGERIHVELAKEVPAVGVDTAEDLEKVRAILAAN

SEQ ID NO: 2652 - protein, 332 aa, H. influenzae strain 86-028NP
MPFWYSNSKLIWLLSPFSLLFWLISQLRHALFCLGIKSSYRAPKPVIIVGNLSVGGNGKTPVVVWLVEELKKRGLRVGVISRGYGSKSKTYPLFVTENTRPIEGGDEPVLIAKRTNAPVVISPNRQQAIELLLSQAECDIIVSDDGLQHYKLQRDLEIVVMDAERALGNGFVLPAGPLRELPSRLKSVDFVITNGGKNQYSDAVMYLVPHFAINLKTNEKRQLKEFQSGVAIAGIGNPQRFFTMLEKLGIQLERTQAFQDHQHFEASQLEKLAENQPLFMTEKDAVKCQSFANDNWWYVPVDAEIIEAEKQCENLPHFWDKIDKLVAQYRNG

SEQ ID NO: 2653 - protein, 587 aa, H. influenzae strain 86-028NP
MQEQKLQENDFSTLQTFKRLWPMIKPFKAGLIASGIALVFNALADSGLIYLLKPLLDDGFGKANHSFLKIMAFVVVGMIILRGVTNFISNYCLAWVSGKVVMTMRRRLFKHLMFMPVSFFDRNSTGKLLSRITYDSEMIASSSSGSLITIVREGAYIISLLAVMFYTSWELTLVLFVIGPIIAVLITIVSKIFRKLSKNLQDSMGELTATTEQMLKGHKVVISFGGQFVEEERFNKVSNNMRRKGMKMVTADSISDPVVQIIASLALVAVLFLATTPLIAEDNLSAGSFTVVFSSMLAMMRPLKSLTNVNSQFQRGMAACQTLFAILDLEPEKDNGTYKAEPAKGALEFKNVSFAYQGKEELALNNISFSVPAGKTVALVGRSGSGKSTIANLVTRFYDIEQGEILLDGVNIQDYRLSNLRENCAVVSQQVHLFNDTIANNIAYAAQDKYSREEIIAAAKAAYALEFIEKLPQGFDTVIGENGASLSGGQRQRLAIARALLRNSPVLILDEATSALDTESERAIQSALDELKKDRTVIVIAHRLSTIENADEILVIDHGEIRERGNHKALLEQNGAYKQLYSMQFSG

SEQ ID NO: 2654 - protein, 788 aa, H. influenzae strain 86-028NP
MKLNLITLAVLLIVADLTLLFLPQPLLLPWQVALVIALVLIFLFIFLRRNFLVSLAFFVASLGYFHYSALSLSQQAQNITAQNQVVTFKIQEILHQQDYQTLIATATLENNLQEQRIFLNWKAKEVPQLSEIWQAEISLRPLSARLNFGGFDRQQWYFSKGITAVGTVKSAVKIADVSSLRAEKLQQVKKQTEGLSLQGLLIALAFGERAWLDKTTWSIYQQTNTAHLIAISGLHIGLAMGIGFCLARVVQVFCPTRFIHPYFPLVFGVLFALIYAYLAGFSVPTFRAISALVFVLFIQIMRRHYSPIQLFTLVVGFLLFCDPLMPLSVSFWLSCGAVGCLLLWYRYVPFSLFQWKNRPFSPKVRWIFSLFHLQFGLLLFFTPLQLFLFNGLSLSGFLANLMAVPIYSFLLVPLILFAVFTNGTMFSWQLANKLAEGITGLISVFQGNWFNVSFNLALVLTALCAGIFMLIIWSIYREPEVSSSTWKIKRPRFFTLNLSKPLLKTDRINVLRCSFGIILMCFMILLFKQLSKPTWQVDTLDVGQGLATLIVKNGKGILYDTGSSWRGGSMAELEILPYLQREGIVLEKLILSHDDNDHAGGASTILKAYPNVELITPSRKNYGENYRTFCTAGRDWHWQGLHFQILSPHNVATRADNPHSCVILVDDGKNSVLLTGDAEAKNEQIFARTLGKIDVLQVGHHGSKTSTSEYLLSQVRPDVAIISSGRWNPWKFPHYSVMERLHRYKSAVENTAVSGQVRVNFFQDRLEIQQARTKFSPWYARVIGLSKE

SEQ ID NO: 2655 - protein, 145 aa, H. influenzae strain 86-028NP
MSKASLSLLDLAGVKPYQMKKDEEYMNEEQILHFRKILNAWHEQIVEEASRTVAHMQDEVTNFPDPADRATQEEEFSLELRNRDRERKLMKKIEATLKKLDTDDFGYCDCCGEEIGIRRLEARPTADLCIDCKTLAEIREKQVAG

SEQ ID NO: 2656 - protein, 452 aa, H. influenzae strain 86-028NP
MPKARAKKSEQTRRYDKNVIKAAQFDISPSDFSRNALNVVEKLQRQGFEAYIVGGCIRDLLLGKKPKDFDVATNARPEQIQNIFQRQCRLVGRRFRLAHIMFGRDIIEVATFRANHSDARNENQAKQSNEGMLLRDNVYGTIEQDAARRDFTVNALYYNPQDNTLRDYFEGIKDLKAGKLRLIGDPVTRYQEDPVRMLRSIRFMAKLDMFLEKPSEQPIRELAPLLKNIPPARLFDESLKLLQAGQGVKTYRLLRQYSLFEQLFPALSAYFTEKEDSFAERMIVTALSSTDERVADKLRINPAFLFAAFFWYPLREKVEILKNEGGLNNHDAYALAGNEVLDLFCRALAAPRRHTAVIRDIWFLQLQLLKRTGSAPMRTMEHPKFRAGFDLLAMRAEIEGGETIELAKWWHEYQFSNGEQREQLIHEQQRLHPKPKKKYYRPRRRKITRSAE

SEQ ID NO: 2657 - protein, 160 aa, H. influenzae strain 86-028NP
MITAYIALGSNLNTPVEQLHAALKAISQLPNTHLVTTSSFYKSKPLGPQDQPDYVNAVAKIETELSPLKLLDELQRIENEQGRVRLRRWGERTLDLDILLYGNEIIQNERLIIPHYDMHNREFVIVPLFEIASDLVLPNSQIITELVKQFADHKMIKLNP

SEQ ID NO: 2658 - protein, 158 aa, H. influenzae strain 86-028NP
MESLTQYIPDEFSMLRFGKKFAEILLKLHTEKAIMVYLNGDLGAGKTTLTRGMLQGIGHQGNVKSPTYTLVEEYNIAGKMIYHFDLYRLADPEELEFMGIRDYFNTDSICLIEWSEKGQGILPEADILVNIDYYDDARNIELIAQTNLGKNIISAFSN

SEQ ID NO: 2659 - protein, 432 aa, H. influenzae strain 86-028NP
MKTKILFFLFFSTFSFSIFAAPITIAIDPGHGGKDPGAISRNLGIYEKNVTLSIAKELKALLDKDPHFRGVLTRKSDYYISVPERSEIARKFKANYLISIHADSSESPDRRGASVWVLSNRRANDEMGQWLEDDEKRSELLGGAGKVLSHNNDKYLDQTVLDLQFGHSQRTGYVLGEHILHHFAKITTLSRSTPQHASLGVLRSPDIPSVLVETGFLSNSEEEKKLNSQTYRRRIAYMIYEGLVAFRSGKTNTLVKDNLVQNIKQNDIKKSGKNNRTSEQNINEDNIKDSGIRHIVKKGESLGSLSNKYHVKVSDIIKLNQLKRKTLWLNESIKIPDNVEIKNKSLTIKENDFHKKQNSSVNNTNKDLKKEKNTQTNNQKNIIPLYHKVTKNQTLYAISREYNIPVNILLSLNPHLKNGKVITGQKIKLREK

SEQ ID NO: 2660 - protein, 629 aa, H. influenzae strain 86-028NP
MPIKILSPQLANQIAAGEVVERPASVVKELVENSLDAGANKIQIDIENGGANLIRIRDNGCGIPKEELSLALARHATSKIADLDDLEAILSLGFRGEALASISSVSRLTLTSRTEEQTEAWQVYAQGRDMETTIKPASHPVGTTVEVANLFFNTPARRKFLRTDKTEFAHIDEVIRRIALTKFNTAFTLTHNGKIIRQYRPAEAINQQLKRVAAICGDDFVKNALRIDWKHDDLHLSGWVATPNFSRTQNDLSYCYINGRMVRDKVISHAIRQAYAQYLPTDAYPAFVLFIDLNPHDVDVNVHPTKHEVRFHQQRLIHDFIYEGISYALNNQEQLNWHTDQSAVENHEENTVREPQPNYSIRPNRAAAGQNSFAPKYYEKPQQNQPHFSNTPVLPNHVSTGYRDYRSDAPSKTEQRLYAELLRTLPPTAQKDISDTAQQNISDTAKIISTEIIECSSHLRTLSLIENRALLLQQNQDFFLLSLEKLQRLQWQLALQQIQIEQQPLLIPIVFRLTEAQFQAWQQYSDNFKKIGFEFIENQAQLRLTLNKVPNVLRTQNLQKCLMAMLTRDENSSPFLTALCAQLECKTFDALADALNLLSDTERLLTQTNRTAFTQLLKPVNWQPLLDEI

SEQ ID NO: 2661 - protein, 311 aa, H. influenzae strain 86-028NP
MKPTAIFLMGPTASGKTDLAIQLRSSLPVEVISVDSALIYKGMDIGTAKPSKEELALAPHRLIDILDPSESYSAMNFRDDALREMADITAQGKIPLLVGGTMLYYKALIEGLSPLPSADENIRAELEQKAAQQGWAALHTELAKIDPISAARINPSDSQRINRALEVFYITGKSLTELTEEKGEALPYDFVQFAIAPQDRHVLHERIEQRFHKMIELGFQAEVEKLYARGDLNINLPSIRCVGYRQMWEYLQGDYDHEEMIFRGICATRQLAKRQLTWLRGWKTPIQWLDSLQPQQAKETVLRHLDSYQKG

SEQ ID NO: 2662 - protein, 981 aa, H. influenzae strain 86-028NP
MTALSALIEQKLQSLGTILCQSFPELSPEKIHEAIQQNSNHPELPVYQLGYAIAMSDFVEKVLQKYPHLVKQWWEKSPCFADCTAYIERLNRELANVHDETALYQTLRQFRNIEMAKLSFCQSLNLATVEEIFVQLSQLAESLIIAARDWLYHQACAEIGTPMDEQGNPQQLYILGMGKLGGFELNFSSDIDLIFTYPSQGETSIENTNARRSVDNGKFFTRLGQRLISALDEFTSDGFVYRTDMRLRPFGDSGALVLSFAAMEQYYQDQGRDWERYAMIKGRVLGVQTKDPNVSKLQKMLRPFVYRRYIDFSVIQSLREMKGKIEREVRRRGLKDNIKLGAGGIREVEFIVQVFQLIRGGREINLQQHSLLKILPEITKLGLITEQQFHDLRESYIFLRRVENILQAINDQQTQTLPTDEIDQIRLVKACKTFTCLNENNQTIEKHYPIENWDDFYRTLQQKQEKVRAVFTQLIGDEQDEPSQTDSQWQDFLEADFEDIEQTLLESGVSENNIDEVLEKLAQFKDGLNHRVIGSRGRDVLSHLMPTVLALIFEQENYRTLLPRILNIIEKISSRTTYLELLLENPRALQQVIELCAQSQLISEQLARYPILLDELLNTEALRHPLPFTQYPAELHQYLLRLPPDDEEQIIDALRQFKQATLLKVAAADILGALPVMKVSDHLTYLAESIIEVVVNLAWKQVSSRFGVPEHLQNNEKGFLVIGYGKLGGIELGYKSDLDLVFLYDAVENQTTGGKKVIDSNQFYLRLAQKIVSIFSINTSAGVLYEADMRLRPSGDAGLIGCSLSAFSHYQLNDAWTWEKQALVRARPVFGESSLKAKFEHIRQQVLSASRDIEQLKQDVVEMRKKMFAHLSHSKHSEFNLKTDRGGITDIEFIAQYLMLANAPKKPQLTKWSDNVRIFDDIAEAKIISQTDCDTLKQCYVDLRNAIHHLNLIGKSPVVDETEFVKERSFIQAFWDRLFVS

SEQ ID NO: 2663 - protein, 558 aa, H. influenzae strain 86-028NP
MLTQLTINNFAIVRQLDIELAKGMSVITGETGAGKSIAIDALGLCFGQRVETSMVREGQERAEICATFQLESQNPAYHWLSEQELQDPDNPTECILRRIINADGRSKAFINSTPVSASQLKEIAQYLVHINGQHASQLLLKNDYQLQLVDNFAAHPELLVKMREDYQTWKNLQNQVKTFQQKVAENEARKQLLQYQVDELDEFNLRPNEYLELEDEQRRLSSSEQLTQLSQSALQILSENDTVNIDSLLYRATQYIDELAELDPQYAEVQNMLNDALIQVQEATSEVQNLSSNIEQDPQLLQEIEQRISQALQLARKHQVKPEDLVEQHKKLKAELTALLDFSESEEMLIEQEKRAFEQMQATATALTASRQQSATRLAQNVTQSIKQLAMENAEFYVELNTDLDKVSANGADNVIFTLRSNLGQQPQPLAKIASGGELSRISLAIQVLTSDQSAIPTLIFDEVDVGISGKTASVVGKLLRQLSERCQVLCVTHLPQVACHGHHQFNVEKFTVDNKTETKMTALSQAERVPALARLLGGSEITELALANAQEMLDLVH

SEQ ID NO: 2664 - protein, 272 aa, H. influenzae strain 86-028NP
MHKNLFHWLMERGYQVLVEKEVAITLELPFEHLATLEEIGHRAQLAIVIGGDGNMLGRARVLAKYDIPLIGINRGNLGFLTDIDPKNAYSQLEACLERGEFFVEERFLLEAKIERASEIVSTSNAVNEAVIHPAKIAHMIDFHVYINDKFAFSQRSDGLIVSTPTGSTAYSLSAGGPILTPNLNAIALVPMFPHKLTSRPLVVDGDSKISIRFAEHNTSQLEVGCDSQITLPFTPDDVVHIQKSEHKLRLLHLKNYNYYNVLSSKLGWLKSF

SEQ ID NO: 2665 - protein, 234 aa, H. influenzae strain 86-028NP
MIHKMTALEFNIFVIISFFATLCPITINQFCFTEKKMSEQEQKVEIPEVENQEEVVVEEAQQADPSQEFDPLEEAIARVQELEEQLKTQIEEAANKEQDILLRSRAEIENLRRRTEQDVEKAHKFALEKFSKDILNTIDNLERALATPANKEDESVKALFDGVELTLKELVSTVGRFGVEAVGVVGEAFNPDLHQAISMQPAEGFETNQISVVLQKGYTLSGRVIRPAMVMVAA

SEQ ID NO: 2666 - protein, 114 aa, H. influenzae strain 86-028NP
MTSFAQLDIKSEELAIVKTILQQFVPDYTVWAFGSRVKGKAKKYSDLDLAIISEEPLDFLARDRLKEAFSESDLPWRVDLLDWATTSEDFREIIRKVYVVIQEKEKTVEKPTAL

SEQ ID NO: 2667 - protein, 146 aa, H. influenzae strain 86-028NP
MMTDKLNLNVLDAAFYSLEQTVVQISDRNWFDMQPSIVQDTLIAGAIQKFEFVYELSLKMMKRQLQQDAINTDDIGAYGFKDILREALRFGLIEDMSKWVVYRDMRNITSHTYDQEKAMAVYAQIDDFLIESCFLLEQLRQRNQYD

SEQ ID NO: 2668 - protein, 707 aa, H. influenzae strain 86-028NP
MSNFGVIKRDGSRAEFEIQRIINAIKKAASAVNISDEFYCHQIGQEVGNEIFTRHQGEIDINQIQKVVEDKLMASRYPEIARAYIEYRHDRDLAREKRSQLTKEIEGLIEQSNVELLNENANKDAKVIPTQRDLLAGIVAKHYAKHHILPRDVVEAHEKGEIHYHDLDYAPFFPMFNCMLVDLEGMLSRGFKMGNAEIEPPKSIGTATAVTAQIIAQVASHIYGGTTINRIDEVLSPYVQISYEKHLKHAQEWNVPDVEGYAKALIEKECFDAFQSLEYEVNTLHTSNGQTPFVTFGFGLGTSWQSRLIQQAILKNRIRGLGKNHKTPVFPKLVFTIKKGLNQNKGDPNYDIKQLALECASKRMYPDILNYDQVVKVTGSFKAPMGCRSFLGAYEENSHEIHDGRNNLGVVSLNLPRIALESKNEEDFYRTLDERLAIAKKALMTRVARLENTKARVAPILYMEGACGVRLKADENVAQIFKNGRASISLGYIGIHETINALYKKGHIFDDEQLREKGIAIVRHLSEAVKRWQKETGYAFSLYSTPSENLCDRFCRLDTKKFGVIEGITDKGYYTNSYHLDVEKKVNPYDKLDFEMSYPPLASGGFICYGEYPNIQHNLKALEDVWDYSYDRVPYYGTNTPIDECYECGFTGEFECTSRGFVCPKCGNHDSTKVSVTRRVCGYLGSPDARPFNAGKQEEVKRRVKHL

SEQ ID NO: 2669 - protein, 286 aa, H. influenzae strain 86-028NP
MSDILNNLIHLLKLEKIDDLIFRGESQDLGFRQVFGGQVVAQALSAAMQVAPEDRILHSCHAYFLAPGDSQYPIIYDVETLREGRNFSALRVKAIQHKNTICHVTTSFQVLEKGFEHQNSMPNVGAPEDFTDENVMLQKVAQTLPEPLNEKFAAERPFEVRTKYLNNPFNGTKLPAEQYSWFKTNGETPLDIKIQQCLLAYFSDFHCILTALHPHEKGFLQKGMKVATIDHSIWFHRPFDLNHWHLHAIESNNAFGGRGLARGQIFSQDGQLIATTQQEGLIRFNE

SEQ ID NO: 2670 - protein, 459 aa, H. influenzae strain 86-028NP
MLKIFNTLTREKEIFKPIHENKVGMYVCGVTVYDLCHIGHGRTFVCFDVIARYLRSLGYDLTYVRNITDVDDKIIKRALENKETCDQLVDRMVQEMYKDFDALNVLRPDFEPRATHHIPEIIEIVEKLIKRGHAYVADNGDVMFDVESFKEYGKLSRQDLEQLQAGARIEINEIKKNPMDFVLWKMSKENEPSWASPWGAGRPGWHIECSAMNCKQLGEHFDIHGGGSDLMFPHHENEIAQSCCAHGGQYVNYWIHSGMIMVDKEKMSKSLGNFFTIRDVLNHYNAEAVRYFLLTAHYRSQLNYSEENLNLAQGALERLYTALRGTDQSAVVFGGENFVETFREAMDDDFNTPNALSVLFEMAREINKLKTEDAEKANGLAARLRELGAILGLLQQDPEKFLQAGSDDDEVAKIEALIKQRNEARAAKDWATADAARNELIAMGIVLEDGPNGTTWRKQ

SEQ ID NO: 2671 - protein, 169 aa, H. influenzae strain 86-028NP
MVTLHTNFGDIKIKLDFDKAPVTAENFLNYCKEGFYNNTIFHRVIDGFMIQGGGMESGMHEKATKAPIQNEANNRLSNKRGTIAMARTSDPHSATAQFFINVADNDFLNYRSKEMFGREVVQEWGYAVFGEVVEGMDVVDKIKKVKTGNKGFHQDVPTEDVVITLVSIE

SEQ ID NO: 2672 - protein, 143 aa, H. influenzae strain 86-028NP
MSIKQHRPKVGEILECDYGQFSHTCHVDGHIPPEMVKKRLVVVLNAKLNGLILVAPISSTINLDGIKNGYHIEIDSELIKATSFYDKRTRWIKSELIQSVSRLRLYHIYDKGTKITQYLPRDVVTKVQRAIIKAINASSLLDK

SEQ ID NO: 2673 - protein, 262 aa, H. influenzae strain 86-028NP
MHFFDTHTHLDYLQQFTGEPLSQLIDNAKQADVQKILVVAVKEADFKTIQNMTALFPDNLCYGLGLHPLYIQEHAENDLILLEQALKNRDANCTAVAEIGLERAIPDLLTDELWAKQCHFFESQLYLAKQFNLPVNIHSRKTHDQIFTFLKRIPLSKLGVVHGFSGSYDQAKRFVDLGYKIGVGGTITYERANKTRQAIAKLPLDALVLETDSPDMPVFGFQGQPNRPERIVESFKALCTLRNEPAELIKKLTWKNACQIFS

SEQ ID NO: 2674 - protein, 85 aa, H. influenzae strain 86-028NP
MVTSGNYASYYLALLPSENGETIDNWVLPLGTQGLTFEADSWNSLGMRSNVSCFMRMTDMPLDRSWRVAWNSPLITCMPWQLEQR

SEQ ID NO: 2675 - protein, 91 aa, H. influenzae strain 86-028NP
LRGPYTSLVDLFESALPDILMLEFSTPRAGELSSLLESEILRQKCILGLGVINPRSDEVETVTQIVQRAEKALNYLPPEQISKFQTKKLPH

SEQ ID NO: 2676 - protein, 107 aa, H. influenzae strain 86-028NP
MSEVLHINDADFESVVVNSDIPVLLDFWAPWCGPCKMIAPVLDELAPEFAGKVKIVKMNVDDNQATPAQFGVRSIPTLLLIKNGQVVATQVGALPKTQLANFINQHI

SEQ ID NO: 2677 - protein, 331 aa, H. influenzae strain 86-028NP
MKIAIYSTKSYDRKYIELINAKYNFDLEFFDFMLNESTVRLAEHCEVVCIFVNDNGSRKVLEKLAALGVKIVALRCAGFNNVDLKAAQELGIQVVRVPAYSPEAVAEHTIGLMMTLNRRIHRAYQRTREANFSLEGLIGFNMYGRTVGVIGTGKIGIAVMRILKGFGMNILAYDPFKNPLVEELGGQYVELDELYAKSHVITLHCPATPENYHLLNREAFAKMKDGVMIVNTSRGSLIDTQAAIDALKQRKIGALGMDVYENERDLFFEDKSNEVIQDDIFRRLSSCHNVLLTGHQAFLTEEALTNIADVTLSNVYKLKSGKVCENIVLPS

SEQ ID NO: 2678 - protein, 381 aa, H. influenzae strain 86-028NP
VRSIFSLFLEDVMTQQYAIDTLLAQAGNRSDERTGAVSAPIFLSTAYGHCGIGESTGFDYTRTKNPTRTVLEETIAKLENGDRGFAFSSGMAAIQVLMTLFTAPDEWIVSSDVYGGTYRLLDFSYKNNNSVKPVYVNTASASAIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKAQPQVESVLYPNKGGMLSFRLQDEAWVNTFLKSIKLITFAESLGGTESFITYPATQTHMDIPEPERVARGITNTLLRFSVGIEDVEDIKADLLQAFANLK

SEQ ID NO: 2679 - protein, 278 aa, H. influenzae strain 86-028NP
MDFSSVSKKPYIITVACTKGGSAKSTNAANIGAFCADHGLRTLLIDTDTQPTLSSYYALTEEAPGGIYEFLTRRDIEPSHIISKTSIPNLDLIQSNDPSNNVSQTLRNAPDGAIRFSHLIKNIDNYDVIVVDTRGTRDITVDMSVLAADILFCPILPHILSAKEFIRGTIGMYQDLETFESFGFKLPPLKAIANCVDNTNDVKFVLNQLHVLFETNFDESKTFLDFSIPAHVAYREAATYSLPVYRHSQAEYPVIKELCCLLLPQFKTLFDKPMKKEG

SEQ ID NO: 2680 - protein, 451 aa, H. influenzae strain 86-028NP
MTDKLIASIEAESAVIGALIIDNDKFDEIATLLRSDDFYVSAHKVLFEGVSHLLTQGKPADILTLEQYFKDKKLIDQIGGLAYLADIIHNTPSASNITAYAEIISRYSKQRRFLTLGQFIVTEMQSSKDEIELTSFEESVDKQYTNIVIEQETDGVADLNASFERILSRMETSSINADPVSGTPTGIIELDRATTGGQPGELIIIAARPAMGKTTFAQTIAASTLDKFPDSPIQFYSQEMPADQLLERFMAMRSRVSLQSIRQATELEEEEWTRLANAMGTIKKDWKDRLLIDDEASLTPHRLRAKVRKNTRLYGKPKAIFIDYIQLMRTGNKTENRNLELAEISNDLKKLAKETGCPIYALSQLNRGLENRANKRPINADLRDSGSLEQDADVIIHLYRDEIYNPDTEDKGIAEIIIGKQRNGPLATVKTLFQGQYSIFENLTTQDRYYE

SEQ ID NO: 2681 - protein, 566 aa, H. influenzae strain 86-028NP
MNNPFIAKNKKQQSQLDAIAKGLNVQPINNQSAAYQTTTATHYPAQSKYITVTLDKLRPYEHNPRKTRNPNFEMIKESIRRRGLDHKPNITQRPGEPFYIIADGGNTRIQALKELFTETQDQRFWSIECLYKPWKGESADSVEAELDLLIGHLIENDTRADLTFIEKALGIQQAKEYYEKKLGKSLSARELSSELEKDGYIIQFSMIAKMGRCIEYLYPYIPDVLFNGLGNAPIDKLLAIRNNALAIWQNYQFELEVSFDEIWGHSLARCNDDQPFHIKVFQDHLIDEMSSMLGDRVSYEVLYLEIDLDEQKFKKMAQKQHEIQQSVQESIQDVQAFNTPQPQETALDTLSQPSVVNTPKMTTPEKKSIPAPVLKQASVEISPSFENEADDKTEDEEFDETNASSDGLSFDFAKNLTQQFGITPGMSIQEQRQQRAEENGLGFACVGRQPVDDIWKIYPGRQHKVEAYSLALDIAESVGLTDYIEHVVKEPVDYTYRVKPLDKDVSGVAQMCYDFLNLLQTDVHPQTSFTLLPEYLLNTQEIDDTTLVKLFRLIRLVRYIRSEGDA

SEQ ID NO: 2682 - protein, 183 aa, H. influenzae strain 86-028NP
MSMFSNLNQVVLNEILVNLQEGNINVCRNYGFSKQELQEIEKLSTEEVYELANTKAPFAKVEINHDAFWRLVARVRMSSQERRLIDRALMLGASIQMLNSYFGLTTSKVSARRSLLGKQEPMGRKPAATEEEEKLIWDLWQEHKGDVQTIESTEGLELLILIAEETGINLTEIWKLVSRWNAA

SEQ ID NO: 2683 - protein, 407 aa, H. influenzae strain 86-028NP
METKLQEHGLLFFGNQHETVPTRLLFDPYLTSRAKLAWQLIKYKAREFQSGMFPSYEVLAKLLSDKPYDEAELSRKLVSQTLLLLRLTRWLTLCETVRNEQGQVLGNFYILHDEPMPIIDTIQLNHDYIALLEKSIQHRDNFVRGVANHIVENLLSDNTQWHYISHIDWMRARLQDYQKRPKMDISEQEESTFIQENLLSSNKELSEKTGELSKNHLSSKMELSKIKQSSKKELSTQNDDKSLISGLVPKGNSGFSQYSTGTSIYINTYCTGNADEIDWPTNIQFSSLEKTAIMQAMRGLDLGICKAILFELEQRVAKGEVKKPQGYVVTLIQRAHRGEFKPYLYEQFLATQAQSLSSKNRLSQHDETSLVNNVKADSTIKPMRVQSEEERKARADRIRQFKASICN

SEQ ID NO: 2684 - protein, 251 aa, H. influenzae strain 86-028NP
MTTTYNQQLGPLRSEITFTLHTQYATRLWNGRDLVKNEAGEVVTSSILSIPNALSLLSQIQQAAEQDDPYADDYLLRFEQKVLGFRKEMQDMTWRMVNLYSEKIPENFQIERCANIAPIQYPIFVNTQLGYQLLYLLADFDSLARTVMTASHIALLTKDDAYDWLESGAKLIRRAFGVLENYRNSGITRQDALENNARYQAAVKRMKYTLTPDVLSGTTRATFAPTIKKSSLAESDDNGSVEVQITANKTE

SEQ ID NO: 2685 - protein, 162 aa, H. influenzae strain 86-028NP
MEIGIMDNVLIPSDMYKQLGRTTPLNDSLKQLFSELDSVQQYELLAESLATVREALMLQQNEMLQNVRKSELSVLPIHMIRDKASSSGGTFLRWRSFQASKTGDAVLNPVFNNPQLSSDLRQKLVSAEKERILINLQVSVLNFMMRQVSSAVDKIKEIEDHL

SEQ ID NO: 2686 - protein, 140 aa, H. influenzae strain 86-028NP
MAGINKVIIVGHLGNDPEMRSMPNGEAVANISVATSEAWTDKNTGERREVTEWHRIVFYRKLAEICGQYLKKGAQVYIEGRLRTRKWQDQNGQDRYTTEIQGDVMQMLGTRPQSADGANNSQPMPQQDASANAFDDSIPF

SEQ ID NO: 2687 - protein, 172 aa, H. influenzae strain 86-028NP
MKKIIFVLSAVAALSGCAELNSLNDAVGNVAGQLSSVLGGGNSSSSSSGVAYTQSSRSHRYNVEDSITSSKNIDSLYVKIKRNLKFKTREEALSGLSGYERQRYESLLDEEGHAHEATPGVYYHMANSYVGGRKIDITLAKEDGKVRISWIASSNESDFAQFVKSEVIKAIK

SEQ ID NO: 2688 - protein, 185 aa, H. influenzae strain 86-028NP
MIKLTPSSIGVMVDTLRYSGRDRYIIFRMKTREQKVVYMRYPQHIENMANQENMIVIVDAQKFLSLWQRSPYEVDKNTCAGDESTWRKDYKFHHAENGFAKSMDSPVPLADVNVHIKDGEISCSLNDGMTRTLWLLANGVKEFPILVRNHKEKAKILSKYASPLSSLHFEPLNLFFAITGEKYPL

SEQ ID NO: 2689 - protein, 686 aa, H. influenzae strain 86-028NP
MRENIMKLFLCEKPSQGNDIAKVLGATKRGEGCLSTPDGQLTVTWGIGHLVEQFNPEEYDPAFKKWAFETLPIIPGKWGLSPKKETKKQFNVVMKLIKQAKLVVIATDIDREGETIARELLDLAGFRGQIKRLWLSALDDTSIRKALGALKNNEETLPLYYAGLARSRADWLIGMNFSRLYTLLAQQQGYQGKPLSVGRVQTPTLSLVVNRDREIKNFIPKQHFALQVMLSDGNQHFATQYVIPEQYCDPDGLCLSAQVIQAANQQIRQFGQAKVESVETKRERQNAPLCFALSDLQSEANRLYGLGAQRVLDIAQSLYETHKATTYPRTDCGYLPESQFAEAPQIIQCLLQSDNRLHPLAGMLNLNQKSRVWNDKKITAHHGIIPTMIKADISKMSDEELKLYDLIRRRYLAQFLPVSETDKTQIILKCGQHILSARGNVLIAPGWKILFGKSLDEDDDAPQALPTLKQGQICQISDSEIKTLQTSPPNHFTEGTLLTAMKNAARFVTDERLKQRLRETEGLGTEATRAGTIQGLIDKGFLKKKGKSLLATDEAMTLIDNLPQMLKDPGLTALWEQALNQIAERTLSLEVFMQKQEVFVRHLMADCLKKGMSLGNIEIRKCPKCGAPMIKRNGKNGAFFGCSAYPNCQHIENIDSKKNTKSTKNLKKKSSKSVSEQISSLRSLLN

SEQ ID NO: 2690 - protein, 142 aa, H. influenzae strain 86-028NP
MSTQNAQPKYFNLHTSGIGYLSDIREIKPKKGDAFWACRIAALTGSSDSPEYRFFDMNVSGEETVNLIKRCQEAVEAKKKVLVSFVMSDLWYDTFTYSKDSEYHKKGDTGVSIKGRLYRINFIKVDGELKYQAKRQDEQGND

SEQ ID NO: 2691 - protein, 30 aa, H. influenzae strain 86-028NP
MKANNKICWLFLYPEGETPLMGGFSFFISI

SEQ ID NO: 2692 - protein, 213 aa, H. influenzae strain 86-028NP
MNTYAKFCPNVFVAKCPDAHQKGDVIILTSKYGKETEVEIHNLVKTSEDAYFYSFTRCDGVNSQVRAEQKAERYQNAANNALKRSEQYCEAANEGREFLSLGEPIKIGHHSEKRHRALIERNARRMDKSIEEMRKAESYDGKIAYWEQMAGKIDLSMPESLEFFKFELEKAKEKHQELKDKPELRTHAFSLTYAKKAVNELEKKVKLAELLWA

SEQ ID NO: 2693 - protein, 135 aa, H. influenzae strain 86-028NP
MFYYVNSGLELITLTTQEFISEFLGKATTPKGIEPNHFYDPQTKLVYAWYSGKCVATSEYQYTPQEAEALLVELALENASNNGDGSIMFQPSPTKEALIADMSNYLEYCIDDESEHDLEFAAKIKQIIDSLKTSD

SEQ ID NO: 2694 - protein, 156 aa, H. influenzae strain 86-028NP
MFKLNEQQQAILEQAQVILTKVMEEKPFYQGAQEFTEPSIAKLYFQTIIGNEERENFVVLFLDRIHRLIKSEVMFQGSVSETSVSIREIIRQALKLNASAIIIGHNHPTGNVEPSDADKYITKRLKEACELMDIKLLDHFIVSGSASFCFTDNHLI

SEQ ID NO: 2695 - protein, 198 aa, H. influenzae strain 86-028NP
MCKENRILELGKIFVSRRILAELTTEKINEVISWHQNGCIIMLGNKDWIEKPPHPLSEIVMNFYQADNGKDTIQLSTSVDDDGNRTTKISFSDESEDEQRGHFDWDIYQSKRTPLKLGDVSCTICAKQLLGMPTIHRLIEKQLGYDWGATCVEDWIENDHAVEKDKRIVSQHFIDGESVFVITEADRSSTTIMLGYEY

SEQ ID NO: 2696 - protein, 254 aa, H. influenzae strain 86-028NP
MINKTLFNSITMPYLTSSQTECLKWLALITMIIDHIGVAFSNAYPALSWCRVIGRFSYVAFGFIIALNLSRDKVNFKSYFTWMIATAFLSEISFTLFEPNYDRLNVLFQFLSVIGVIWVYKNRQDLNSWVMFFGLGFFIILSALSDYGLPGLLYCIGCYLFLQTKDTQFRLITMLTCVLLALFVNHSFIDNFGETIVETISVVTVVVGTMIFILHPKGLRQCNISISRMPKLFFYLFYPVHLTIIIGIKYIFLS

SEQ ID NO: 2697 - protein, 209 aa, H. influenzae strain 86-028NP
MKKFLLTTFALVVLSGCAHKQQTADEQQALENPNIQQGQHQVLQPEDRIVRPDIYTDYQPERTEVLREGRYTLINFSPEEGQKYLLDQSVTVNMLGKKKRALTATVEQGLRTTLKDTGLSLCHGFGQNEPTLSTLYSRPLPKVHYQFGPMALRDALQMLAGPAYEITINDVSRTVCFKLRPAVPERATGEKPKVETTTTTTTTTEIIEE

SEQ ID NO: 2698 - protein, 246 aa, H. influenzae strain 86-028NP
MNHVKKISYVAMILGMFSTAVFAEVTAANTLATQSLNQQNLVTNKLNQQELLAKSQEWGLTEQEWQRYQELNQGARGIWSPGLDPLTSLGVESRNEQERERYARLLAKKMHDRMERELQFQRTYDRVFAEMYPNEQPFKVEPHISERFGRVIYFTRLENCDKCEANADRVLQYVNDKTPIDIYFVGVNNNEQIYNWAKKHNIDPNKVNRKLITLNHDNGAWLQYADGKMPAAFQIQQDGQWQQIVY

SEQ ID NO: 2699 - protein, 252 aa, H. influenzae strain 86-028NP
MATNRLLKIVFSLIGLGVATHSVAFNGFGTDIDGYIKDASNRYQVDEAMLRGLVKIEDGWYGNVSPTGATGVGQFTRGTWNWLATTDEGRALGMTQITRYNRDTPFDPRKNNQLNTLATALLARWHINQFFERGIKPSHENLYLAHNIGIDGLHRALQGRATREDILNMKRNGMKKGMSVQGFLVYQSERFNVSKQIANFQRPSVSPRYQIENKPLPANLHWVSPTETAMRWVEPASNQTNQQAIRWQNPTN

SEQ ID NO: 2700 - protein, 168 aa, H. influenzae strain 86-028NP
MQYKSFFLSLVCLGAVVQAQAELKVIGDFGGESAVRFYEALQPDESMVQAYPNSVPSTLTEADILPVISHRMTPGQIQPVRMNLPGMLPIFLIGTDNLSKNWLHANYNYLKKIGAMGLVVSVKTTNELSELRQLAPDLTLMPTPGDDLASRLNLAHYPALLTSEGLSQ

SEQ ID NO: 2701 - protein, 749 aa, H. influenzae strain 86-028NP
MSQKHVLEGLLRPPVEFFPAAVHGTCALVCCGAPWSLALNPLIGYGLGAAFAGMGVMRFRQGMEIVRYHRNLRRLPHYALTSRQIPVSKKALFLGRGFEWEPKHTQRLYDCFSANGQIYWKNGKWFKAARDYEKVHDNWLSRLTSMDSPLNPVRPLPPVGGIPVMHGVEPNERDIMLPLGDRGGHTLVFGTTGVGKTRFAEVLVTQDIHRGKTPEEREVVVFFDPKGDPDMLKRMYAEAKRAGRENEFYVFHLGHPEISARYNPVGRFGRISEVAGRISGQLSGAGNSAAFKEFAWRFVNIVSRALVEMGKRPDYVQISRFVQNIDALFLDYAKLHFDAVDKKIWPTLASVAANLDVKNLPFSMKDRPLIAVINQYILENKIFDPVLEGLSSAVRYDKTYFDKIVASLLPLLEKLTTGKTAELLSPDYTDIHDERPIFDWESIIRKRGIVYVGLDALSDATVAAAVGNSMFADLVSMAGHIYKFGVDEGLPDAFKTKSKPPKINLHCDEFNELMGDEFIPLINKGRGAGMQVTAYTQTLSDIEARIGSKAKTGQTTGNFNTLLMFRVKEPATAEFLTRQLNDVTIYQSMVTSSTTDNSNPDDGKAFTSNTGERISEKMVPMLSPAHITNLPKGQAFALLEGSTLYKLRMPLPAVDKDDVMPESLQELTAYMRKNYHISPNWWQSAFSDYAPSQDIATAFQSMSLNRAPSHAGEEMLFGDVEAPVAEDMEDEDIDQNDDTDEDDFDDTDN

SEQ ID NO: 2702 - protein, 228 aa, H. influenzae strain 86-028NP
MAEQQVKKKKKGLFYYINAVLAALLGSLILSIILEWLGIAFLWPEEGHLHSQKMMLTELGWLSDSLTRGLFYHSPKELAEGLILSLHEWLFVKTGVKDWLANPREHSGVGLWVYHYGRAYIESVIYVFITFVIRLVVIVFTSPLFLLAAFAGFTEGLMMRDRRKFGAGRESSFLYHHARRLIGPIMLSAWVLYLSIPISIYPNIILVPAAFLFGLSICVTAASFKKYL

SEQ ID NO: 2703 - protein, 116 aa, H. influenzae strain 86-028NP
LESVSSKEFSVTKNIFSLSLAIGLLFGAISAQATEQEHLAQAIKQLDAAKLSLQRAAASAKVSAKSREYFDYASAHQDIATVQAGIKQYINPSRAIPRNPKAIRNLKEDYLNLRSQ

SEQ ID NO: 2704 - protein, 133 aa, H. influenzae strain 86-028NP
MKLIKSFFQNVSSRFLAVVTLLWLSVENAFATGGGNGINASKIPDFKIPGVDSNTKDPMEIIYLVAKSLATLCAILFAAWSIMTVVKALIKTYNAATDENDKKGWGPFIIALILGFILIFFSLWLVKLAIGLF

SEQ ID NO: 2705 - protein, 123 aa, H. influenzae strain 86-028NP
MSSDKEQTIPFLPTRLNRESSVYGGLSVSEFMLAAAMGFILGAVLGLLCCFALGFDFWLLIPSLAMLFCILSVVIGKVIIARLKRGKPEAYLNRMIEVKLDGILGGNRFISRQGTWSIRRVKK

SEQ ID NO: 2706 - protein, 214 aa, H. influenzae strain 86-028NP; identical to SEQ ID NO: 709

SEQ ID NO: 2707 - protein, 289 aa, H. influenzae strain 86-028NP
MKKLTLLLSAAFIFSPMTASADVLMKWARKPLPIDLQIEKERILFVDKNVKVGYPPELDSKLRIQSTGGAVYLKATADFPKTRLQLMDVATGEIILLDVQAKHSVANASEPIRFVYENKVEKQTTAYGQDANAYNEPMPNARPALPAPAALTRYAAQMFYAPLRSVEPLEGVRQVSHRLPTPLKTLLPALPVRATPLLSWQLDEYVVTAVRLQNQGQSRIDLDPRELQGRFYAATFQHNWLGGHDTPEDTTTLYLVTEGSPNHSVIPQSNSYKPKKLKKVTTTVTTQTK

SEQ ID NO: 2708 - protein, 466 aa, H. influenzae strain 86-028NP; identical to SEQ ID NO: 699

SEQ ID NO: 2709 - protein, 135 aa, H. influenzae strain 86-028NP
MKVLMMMGVILAASSVLTGCSTSQGDLLPTGDATMKDIWNRGGNDSNITSYRTPNGRLIDAPNYVSSREQQTYTRTAENEVKNLFPRLPNPDLVMYVYPHLTDSSEQMPVPGYSSVIPFYGRVQYAQPGERTRMY

SEQ ID NO: 2710 - protein, 956 aa, H. influenzae strain 86-028NP
MALFQDVLEAFFPAKKGDKPQPKKEPILTSIAPEEAQQDDTNNVEETIEITPVMRNRKMTREQHVKMLYGRDPSFISNLPYAEYLEEEGVMLFDDAKSAGAVFDIKPIGTEGRSSDYLNRVRTLVKDALQDSFDELDTNPYVVQFYCQDDKDLSGYVENLRQYIKTTSPEASGSEFTEQWLGEMERHLKAVGKPGGLFVDDRVTNTAWAGKVRKTRMVIYRYAGNNETDTIEKLNTACDRVQSAFITAGLTMERQNETQIHRWLLEWFNPNPSRYFNGLDDKACYDLLSLSKDESALPLQDQDFSENLFFTPPESKNGYWYFNEQPHEVIVVDNIRKQPDVGHMTGEVTRGRNINALFDLLPESTIMAITVVIHPQDKLQAHLDKLSSRAVGNNYESIYLKQDALTVTEYLKDGHKLYQAGMVFYVRGKDDQELRIRSRELRTVLLSNNLVPVKEGNEVAPLNSYLRWLPMNFNPQLDAKSRFYTKYYWVQHIANMLPVFGRETGTGHPGITYFNRGGSPLDFDPLNPKDRTKNAHKLILGPTGSGKSATLTAQMAQLMAVHRPRLFIVEAGNSFGLFSDYAERYGLTVNRVSLEPSSNIALPLFSEAHRLLEMDIDLEVQDDDDNEDEGEEQRDLLAEMELTARLMITGGEAKEDEKMSRADRSAIRQAILLAAEKTSQETPPRQVLTGDVKAALEELSRRQDIRPERASRLADMAEAMDIFCTGVNGRFFNREGEIWPEADITLVDLAMFARDGYEAELAISYISLINHINSLGEKYQHSFRPIVNITDESHIITVNPLLAKFLVKGSKMWRKLGIWLWLATQNMADFPDESDKLLSMVEWWELLNLSNDEVEQVNRFRRLSEAQKMMLLSAKKADKKYTEGVVLATNMEALFRVVPPSLYLALGMTEKHEKAQRKQLMMEHNCTELDAALMVAKDLDKKRGIAVNDELNSIAA

SEQ ID NO: 2711 - protein, 135 aa, H. influenzae strain 86-028NP
MTFHRIFDIGPRIQSLAFTSDEVKAYVLHFIAKIKTKIGSNCQLSAFPQRVFTQSSWKVHAKGDKGEVHLLFNISGRFQLPVFSSENWPARLNVELTDHVDAYWLIQYLLWKLAAIWESPADLSPVFGDKTVGNE

SEQ ID NO: 2712 - protein, 107 aa, H. influenzae strain 86-028NP
MSQGKKPQSRGWLKNVLRFIAILLFLFLALTAIGIFATQYLQNVDIRAWFIKTQWIWFAVRLLLYGAIMLMVYSISRRQPSSMPAKAKWLIAMILIFAEAITQITLA

SEQ ID NO: 2713 - protein, 497 aa, H. influenzae strain 86-028NP; identical to SEQ ID NO: 689

SEQ ID NO: 2714 - protein, 109 aa, H. influenzae strain 86-028NP
MDAQKFGHTVGQFFKKIDRTLSFLPGKPRKAVVTAAALAASPILAGVIISKTKPSKNIEYLDEEPVSDTSLLSELLANDDSSEEGKWDYGFQGFGYYINGVKVYGDDDD

SEQ ID NO: 2715 - protein, 38 aa, H. influenzae strain 86-028NP
VFLLSAGTNMRWRAPMQIYPDPSASGAVFSAQSFWRHG

SEQ ID NO: 2716 - protein, 1001 aa, H. influenzae strain 86-028NP
MPVDFLTTEQTESYGRFTGEPDELQLARYFHLDEADKEFIGKSRGDHNRLGIALQIGCVRFLGTFLTDMNHIPSGVRHFTARQLGIRDITVLAEYGQRENTRREHAALIRQHYQYREFAWPWTFRLTRLLYTRSWISNERPGLLFDLATGWLMQHRIILPGATTLTRLISEVREKATLRLWNKLALIPSAEQRSQLEMLLGPTDCSRLSLLESLKKGPVTISGPAFNEAIERWKTLNDFGLHAENLSTLPAVRLKNLARYAGMTSVFNIARMSPQKRMAVLVAFVLAWETLALDDALDVLDAMLAVIIRDARKIGQKKRLRSLKDLDKSALALASACSYLLKEETPDESIRAEVFSYIPRQKLAEIITLVREIARPSDDNFHEEMVEQYGRVRRFLPHLLNTVKFSSAPAGVTTLNACDYLSREFSSRRQFFDDAPTEIISRSWKRLVINKEKHITRRGYTLCFLSKLQDSLRRRDVYVTGSNRWGDPRARLLQGADWQANRIKVYRSLGHPTDPQEAIKSLGHQLDSRYRQVAARLCENEAVELDVSGPKPRLTISPLASLDEPDSLKRLSKMISDLLPPVDLTELLLEINAHTGFADEFFHASEASARVDDLPVSISAVLMAEACNIGLEPLIRSNVPALTRHRLNWTKANYLRAETITSANARLVDFQATLPLAQIWGGGEVASADGMRFVTPVRTINAGPNRKYFGNNRGITWYNFVSDQYSGFHGIVIPGTLRDSIFVLEGLLEQETGLNPTEIMTDTAGASELVFGLFWLLGYQFSPRLADAGASVFWRMDHDADYGVLNDIARGQSDPRKIVLQWDEMIRTAGSLKLGKVQVSVLVRSLLKSERPSGLTQAIIEVGRINKTLYLLNYIDDEDYRRRILTQLNRGESRHAVARAICHGQKGEIRKRYTDGQEDQLGTLGLVTNAVVLWNTIYMQAALDHLRAQGETLNDEDIARLSPLCHGHINMLGHYSFTLAELVTKGHLRPLKEASEAENVA

SEQ ID NO: 2717 - protein, 212 aa, H. influenzae strain 86-028NP
MSCPIFDLRYIFMRLFGYARVSTSQQSLDLQVRALKDAGVKANRIFTDKASGSSTDREGLDLLRMKVEEGDVILVKKLDRLGRDTADMIQLIKEFDAQGVAVRFIDDGISTDGDMGQMVVTILSAVAQAERRRILERTNEGRQEAKLKGIKFGRRRTVDRNVVLTLHQKGTGATEIAHQLSIARSTVYKILEDERANFTDLSIPSMYLNTAI

SEQ ID NO: 2718 - protein, 59 aa, H. influenzae strain 86-028NP
MKARFKEWLISLNEIAMNELGIDEMLTHLDDELNIINGNECEQEILNNLIQIFKNSEYH

SEQ ID NO: 2719 - protein, 135 aa, H. influenzae strain 86-028NP
MKKLLTIGAVAMFATPAFAANNIFSCTAENGSPVSVTKNGSDYEFTYGQVSFKNPVKQVFANQDSYVATGSGFITSSLEMRNNGTSYTIQFVQPHNSNSIEEPMLYITNGSKMDTVSCKAGSATQNFERRSMKAS

SEQ ID NO: 2720 - protein, 666 aa, H. influenzae strain 86-028NP
MKLNHALKASYIAISCAILSSTMPVSASNSNPFGFNKADSILSDMVFYQIGGGVGYMAPPSRGTIPAAEFGIGWKANLMCGNFDIKTSIKNQLNGLTEGFKDLYSNVIESATGAVASLPAMVIQRANPQLYDILTNGLYQGKIDFNSLKTSCEEMSKKLADATLNGRWSQSSDMESFKDITSTEPDATRAKKRLEESQGKEGKEWVGGKKRGGQGQEPIKIVEDVAKAGYNMQNKRNVLESGRISGSSCSGLLCQTWDNPKDMTDWLTNVIGEKQLTTCKTDCGTASSSRAGVGLTPEIEKENIKTVTQLQKALNMSTPSVEVLAELSSTTVPVTRGLIESLREDPDAQVLGQRLASEIAVAKTMEKMLLARRAVLTGMREPNVANNKDAQEELEKILTLIDREIGQIRMEIDLQKSLTGNSAVAILQNKELREYNTGTGNVTRDSVDKRISDLANGTNSNAAELADADNINIPRNNVTLEVPQMSNSLSYTGTGGTSGNSRGNTSYSSVPAIKGTALDQATGLLKKFEGFSDKAYWDVNAYRTGYGSDTITKADGTIVKVTKDTVVSRADAERDLARRTQEFANRARNNVSSSTWDKLPPNAQAALTSYAYNYGSLTKDVIAAAQASAQSGDMNALANAVRNRQNNNNGVNAKRRNQEADYILGK

SEQ ID NO: 2721 - protein, 313 aa, H. influenzae strain 86-028NP
MKLKKMTLSGLCIAIALTSISGQASESGQSSLNTASIMASSASTSCLDYKVVGTCFWLFCTKFGCKIRTSTKIKHYIPEVVVSSYNHQAQNPWVEMNFLSNGVKGGDYQSPHKDYTQATFKNVDVIGHPQGAISQMLNSTGYYCKSQTTPFVPYYLSGLDFLAWRFGVPEMVYPEALIPGMREIRANGDTWGNIYPRAGTVTQVHDYKASAVTAHRVADVVTNTFQPHVYIPIAKKDNQSNGEWFPPPVKEGDEKTHKWQQLHPVTSQSCAIFPDNPPSMLSENGSYAWALWRPYKCCKKRGQTFLYSIDWSN

SEQ ID NO: 2722 - protein, 147 aa, H. influenzae strain 86-028NP
MVMSIKKSLFLFGLLPLSVFAQGPNPIITVYSTQDYPILHAELASQVYLLDQVEQWENLISQRLSANPSVAAQQASQIFQSAEWKQSEEQLKRSYQGLISGWQNGIKKVPAVLFQYPGKEDSVIYGETNIAQALSLWQREITKEGTR

SEQ ID NO: 2723 - protein, 139 aa, H. influenzae strain 86-028NP
MIPFGHVIFPRNFLFHIRRMTMSSSTQLEHYDVPSSNPLETPTFSFRVGKHLGRFFVAAKNKATDKYKQVTSGINQSIEDEEARRLCELQMMLDSQAEEYEAIIDDVQRTWLKRTTLFSILFLIVGIVGTVGTLYYLMH

SEQ ID NO: 2724 - protein, 77 aa, H. influenzae strain 86-028NP
MKVTLHNSCLAYLAKHNDSESLIEEVRTQALNAWENRGKDVSSTRIMVNIPSQYGQKYHFFTVSPYANRKDLLSVRG

SEQ ID NO: 2725 - protein, 82 aa, H. influenzae strain 86-028NP
MIKRLLKLVSSNWDKKTMLLVSEDFRKIGTYILGIAFVAMFVQNDNIPLLLAIIIMIFGGIAWFCGVLLAKYCNNLMETDGA

SEQ ID NO: 2726 - protein, 52 aa, H. influenzae strain 86-028NP
MNITLNWNGFLFAIVFVLFFMGTVAFIGVRSLKRQQEQKAQSKKTHSIGVNS

SEQ ID NO: 2727 - protein, 317 aa, H. influenzae strain 86-028NP
MKKRTQPAKDLYQQITDQILEALEQGVMPWQKPWDSGWPQMAIPCNGESGRQYSGINVLLLWMSAIRKNFTQRKWVTFQGANHLGGQVRTGEKSTVIIFYKQNMFEEKDDSGNIVLDENGDPKMKSSVFIRGHHVFNIEQCEGLEKYYEEYPEPEKSSEMQARPDLDVLPNKMGMQLYNKAQDRACYMPRKDCIVMPDFKKFNTADDYYATLLHECGHATGHKDRLNRDGVAKFDKFGSEQYAFEELIAELTSAFTCAHVNVCNNISQNAAYIEHWINALKADKKAIFRASSQAREATQFLLNALELTSNEEAKLAA

SEQ ID NO: 2728 - protein, 253 aa, H. influenzae strain 86-028NP
MDFEKKFTALFKSIAPQYRRSEVFYDFITIFALEFYLIIYGAQADESLRQRYQTAGEHYNEDEKQALSRLFNIIVEALEHKTYDFLGSVFMSLDLGDQYKAQYFTPSHIAHLMAAVTLSDCHSLIKKRGFLTLQEPTCGSGVMIIEAYNYLREEDFNPQQQMWAQARDLDFTAALMCYIQMTLLHIPGEVIIGNTLKDEVNYHLYTPAHIMGNWNKKLESADSYTEAEYQVIEPEPVEEPPLDIDWENEPMFY

SEQ ID NO: 2729 - protein, 188 aa, H. influenzae strain 86-028NP
MYYVTNDLAIDKNTYTRLDLGDDDVILCAGRQADDADTIIIFFETNADPIYIGWASVDTGDVEITYDDWDNYFAGIRQDDVIDEINILLDGIKIYDNMTGHFPIYANDHNNVVGEHKVYFKTDEAYPDPSIDNANREDGYVTYKAGAITEMGRKCYVYWDFVAYDDDGNEIDSDYFDYQNTDCIIKYY

SEQ ID NO: 2730 - protein, 124 aa, H. influenzae strain 86-028NP
MAKTAVHLSKTALQYVTDRTPQGEQKGLSAHINNAFEQLAHLTRAEKPELSKSEWVELYNVYAGSDLTRLVMPFDLADDLRTHYGTLPQDLTALYNKLAGMTQAQQFAVLDAVRVYWASGEDGN

SEQ ID NO: 2731 - protein, 225 aa, H. influenzae strain 86-028NP
MGIKNKPITRPCPQCGRNYQYRRASGRTFELCEYCRNLDCVVCGKKVPPERGRKNTCCAECEKLKIHNIQNAHYAKRIAEDPELNKRNHAKARENRKADPERMHEHLEAQRERHYRRVQDPNYLATRKVYQAQRWQDKKDEILAQRREFWDSLSDVEKAERLERNQAIQRKHKAKKRDQLKLDPQKWAEYQEYQRTKRREHRQRKALNELMVGTKELLNVTNKDK

SEQ ID NO: 2732 - protein, 205 aa, H. influenzae strain 86-028NP
MLPTKTNSFDIVAVKSMTIQDLKAELAKTLSITAEYLMYIAAIWRELESRGEDLSELRHGVMTYIPLIATNQLDARLVVNYAGQKTLLSSMAKLPLREQQKLAEKGTLDVVILGDDNQQLIKEVKISDLTAAQVYQTIGDGKIKTPEQQYQILLVRNKVRSKSKPKKTYRLTQNLKIDGKNLVIAGKHAVSIEILKKYLEDNNEL

SEQ ID NO: 2733 - protein, 199 aa, H. influenzae strain 86-028NP
MALIGFARVSTQQQDLSEQIQVLKEYGCKKIFSGKHSGKAEKNKAQLDELLDYVREGDVVAVTKLDRLGRSLAQCLNTLELFKNKNIGFVAIQQGIDTRTQNNPMGMALIQLLGIFAELERSFIVERTQEGKRTKLASGHKNALGGRPPKVTDKIRKKIYADFKAGDSISTVMKRYDLSKSTVARLKGIYNRENLMSEE

SEQ ID NO: 2734 - protein, 63 aa, H. influenzae strain 86-028NP
MDYDYQKGFEEGYRMIMGASALLPLAPIQPLTPLGSTPFREGLKAGINLAKRNNQQSFNNIFK

SEQ ID NO: 2735 - protein, 84 aa, H. influenzae strain 86-028NP
LNKGVFMKGYEIELEDKGQDFTKLRTDEQGIVIAAEPYQTDVWKGALIPISQQKIGDLCMIHHLPHIEYGYLKYKVLAIKEINY

SEQ ID NO: 2736 - protein, 237 aa, H. influenzae strain 86-028NP
MNLSITNFITSFSRERISVYQNYIHSSEPNLSPADISLKSLKLYLWNIQISSALFEVINLYEVTLRNKIFAVVNSEFSDSINDYYFKKRLSSFFRDKLNELGASTISAPMIVSRLNFAFWTEVLNKHFYYSGSVGKSGHPLYPRLYNFNSSLFSINRKLTREDYNKLTQKLIKINDEVNELRNRICHHEPIFKSKLRAIYIKMLFVLRCLDTNVYKLAKEIERVNKLLKKFEDEINP

SEQ ID NO: 2737 - protein, 417 aa, H. influenzae strain 86-028NP
MVISTGLKCELCGHRYRIRVGVGFDSYQKHYFDCSNCNINIVFAIRTKPPRADVEAVENCSLFSGEPNIELEVLNFHPNCAFNKHDLHNPFCFPTLISGPLIIPHMRYIPGRMQSFDNQFDIPNAPHKWSLIKGMITNIQDNKKASNFVLQYTKHRNKDMNPSSSNFMRDKEIIVYKSGSVYSEFHIIHEFFDSLFYPMLENIVEPIINTIKNIPESKLSSFIRYWQSELKQENQYRYLNTFSEYFRHRDHFGQIVMYSRIGHNVDDLIVSSNGFEQIKLYYGDAYEALTSNMTIIACLNNIMDGREFDEFKSMKLSKYLEINKANKSNPFKLTPIFSVFAENDIESSIRNGSHHASIWRDGEKIMYKSGGTGAEHCIPYTRYLDYCNRLTIKLAALFIIECYLSEYVNDSKSFVVN

SEQ ID NO: 2738 - protein, 638 aa, H. influenzae strain 86-028NP
MGYFFMFSSIFYRLKGKKQDSFTIPVLDSHNHSMSKIDSEGWITPFSASELLNSELRQKYLNLLWQQVSMTQDMFNELYKKPIERYAEMVQLLPASESHHHSHLGGMLDHGLEVLSFAAKLRQSYVLPQNAAPEEQSKQRDAWTAAVIYAALVHDIGKVIVDIDIQLKDGSRWFPWLGVPTQPYKFKYIKGRDYDLHPVMGSFLANYLIPKEAFAWLAEYPEAFSALMYAMADHKDKAGLLSEIVQKADQNSVTLALGGDVSKLTQKPITSFAKQLVMALRHLLQHKFKINTPKGPSDGWLTEDALWLMSKPTADQIRAYLLEQGISAPADNPKLFSEMQSLGIIESTNDGTAIWHCRIKADSGWCPPKAFSLLRIKPEVAWENLNDRPGIFLGRVDIENEEQLNSGEDTKEENSVIMESEMPLPAITGTLNKPDLSENTSSQNTQINTQNSETETDMTDLVMNLFSPVEESQDSTDKKPSQESEINKIASTPSIATDDDTKETEAVSGEIFVEWLKSGIIGNTLTINNSNAKLHIVKGKLFLVTPGIFQLFFNSKGITNFTKKDIENLQYSFQDLKLHKKYRQSNNDSINFWRCKVIGPRRTSQLIGYLIDKTDYFFGNRIPIDNLHLSLIEENESE

SEQ ID NO: 2739 - protein, 280 aa, H. influenzae strain 86-028NP
IKSYEKAIRQLQKNCSIQYPDEISDSLILQWRKRVVGQSIIEVTWNSYIRQLKTIFKFGIEKQLLPFTKNPFDGLFIREGKKKRKVYTSSDLKKLSFGITESKHLPSILRPLWFTKTIIMTFRYTAIRRSQLNKLRIKDVDLLNQVIHIPSEINKNHEYHILPISTTLYPYLKKLLTELSKLNQPVESQLFNINLFSNAVKRKGEKMTNDQVSYIFKVISKYTGIISSPHRFRHTAATNLMKKPENLYIAKQLLGHKDVKVTLSYIEDNIDSIREYTELL

SEQ ID NO: 2740 - protein, 425 aa, H. influenzae strain 86-028NP
MNLYNIKHPEEQVTFSQAVRQGLGWDQGLFFPEVIPKLNNINELLELPLVERSQKILGALIDGELPQATLDAMVKNAFTFTAPLEKVEDNIYALELFHGPTLAFKDFGGRFMAQALAAVRGDGKITILTATSGDTGAAVAHAFYGLENINVVILYPKGKISPLQEKLFCTLGGNIRTVAINADFDACQALVKQAFDDVELRQAIGLNSANSINISRLLAQVCYYFEAVAQLPKEKRDNVVVSVPSGNFGNLTAGLIAKTLGLPIKRFVASTNANDTVPRYLKSGNWDPKTTVATLSNAMDVSRPNNWPRVEELFKRNGWDLTDLGSGMLSDSETEDTLKAMQSKGYLCEPHGAIAYQVLKEQLKASETGIFLCTAHPAKFKESVERILGIQLPLPETLDKHNQLPLLSDEMDNDFAQLRAYLLKS

SEQ ID NO: 2741 - protein, 314 aa, H. influenzae strain 86-028NP
MLRIYAPASSANISVGFDTLGAAISPIDGSLLGDVVQIESISSGFELESAGYFVRKLPKEPQKNIVYQAYVLFSEQLKLRGANVKPLRLTLEKNMPIGSGLGSSACSIVAALVALNQFHNEPFSKMELLEMMGELEGRISGSIHYDNVAPCYLGGVQFMVQSLGNICQKLPFFDNWYWVLAYPGIEVSTAEARAILPKSYTRQNVIAHGRHLGGFVHACHTHQENLAAIMMKDVIAEPYRESLLPNFAEVKQATRDLGALATGISGSGPTIFSIAPDLQTAIKLSSYLESHYLQNNEGFVHVCKVDNEGTREIK

SEQ ID NO: 2742 - protein, 815 aa, H. influenzae strain 86-028NP
MRVLKFGGTSLANPERFSQAAKLIEQAHLEEQAAGVLSAPAKITNHLVALSEKAALNQSTDTHFNEAIEIFYNIINGLHAENNQFDLNGTKALIDAEFAQIKGLLEEIRQAGKVEDAVKATIDCRGEKLSIAMMKAWFEARGYSVHIVDPVKQLLAKGGYLESSVEIEESTKRVDAANIAKDKVVLMAGFTAGNEKGELVLLGRNGSDYSAACLAACLGASVCEIWTDVDGVYTCDPRLVPDARLLPTLSYREAMELSYFGAKVIHPRTIGPLLPQNIPCVIKNTGNPSAPGSIIDGNVKSESLQVKGITNLDNLAMFNVSGPGMQGMVGMASRVFSAMSGAGISVILITQSSSEYSISFCVPVKSAEVAKTVLETEFANELNEHQLESIEVIKDLSIISVVGDGMKQAKGIAARFFSALAQANISIVAIAQGSSERSISAVVPQNKAIEAVKATHQALFNNKKVVDMFLVGVGGVGGELIEQVKRQKEYLAKKNVEIRVCAIANSNRMLLDENGLNLEDWKNDLENATQPSDFDVLLSFIKLHHVVNPVFVDCTSAESVAGLYARALKEGFHVVTPNKKANTRELVYYNELRQNAQASQHKFLYETNVGAGLPVIENLQNLLAAGDELEYFEGILSGSLSFIFGKLEEGLSLSEVTALAREKGFTEPDPRDDLSGQDVARKLLILAREAGIELELSDVEVEGVLPKGFSEGKSADEFMAMLPQLDKEFKTRVATAKAEGKVLRYVGKISEGKCKVSIVAVDLNNPLYKVKDGENALAFYTRYYQPIPLLLRGYGAGNAVTAAGIFADILRTLQH

SEQ ID NO: 2743 - protein, 237 aa, H. influenzae strain 86-028NP
MNIQHNLNLIQQKIETACKEENRNQNTVKLLAVSKTKPISEILSAYQAGQTAFGENYVQEGVEKIQYFESQGVNLEWHFIGPLQSNKTRLVAEHFDWMQTLDRAKIADRLNEQRPTNKAPLNVLIQINISDEESKSGIQPEEMLTLAKHIENLPHLCLRGLMAIPAPTDKIAEQEAVFRKMSDLFEQLKQALPNQQIDTLSMGMTDDMPSAIKCGSTMVRIGTAIFGARNYSTSQNK

SEQ ID NO: 2744 - protein, 378 aa, H. influenzae strain 86-028NP
MKFVIAPDSFKESLTALEVATAIETGFKRVFPDADYVKLPMADGGEGTVQSLVDATQGKLIECEVTAPLGDKVKSFFGLSGDGKTAIIEMAAASGLHLVPPEKRNPLLTTSYGTGELIKLALDLGVESFILGIGGSATNDGGVGMLQALGMQCLDSQDKPIGFGGAELANIVKIDVQQLDPRLQQVHIEVACDVNNPLCGECGASAIFGPQKGATPEMVKQLDAALSHFAEIAERDCGKQIRDQAGAGAAGGMGGGLLLLPSVQLKAGIQIVLERLHLIDHVKDADVVITGEGRIDAQSIMGKTPIGVARTAKQFNKPVIAIAGCLREDYDVVFDHGIDAVFPIIHQLGDLSDILKQGEQNLISTAQNVARVLAFKFH

SEQ ID NO: 2745 - protein, 419 aa, H. influenzae strain 86-028NP
MTTVSAIGALVALIVAIFLILKKVSPAYGMLVGALVGGLIGGADLSQTVSLMIGGAQGITTAVMRILAAGVLAGVLIESGAANSIAETITNKLGETRALLALALATMILTAVGVFVDVAVITVSPIALALSRRSDLSKAAILLAMIGGGKAGNIMSPNPNAIAAADTFHLPLTSVMMAGIIPALFGLILTYFLAKRLINKGSKVTDKEVIVLETQNLPSFLTALVAPLVAILLLALRPLFDIKVDPLIALPLGGLIGALCMGKLRNINSYAINGLSKMTPVAIMLLGTGALAGIIANSGLKEVLIQGLEHSGLPSYILAPISGVLMSLATASTTAGTAVASNVFSSTLLELGVSSLAGAAMIHAGATVFDHMPHGSFFHATGGSVNMDIKERLKLIPYESAVGLMMTIVSTLIFGVFKF

SEQ ID NO: 2746 - protein, 368 aa, H. influenzae strain 86-028NP
MQLDKYTAKKIVKRAMKIIHHSVNVMDHDGVIIASGNSTRLNQRHTGAVLALRENRVVEIDQALAQKWNFEAQPGINLPIHYLGKNIGVVGISGEPTQVKQYAELVKMTAELIVEQQALLEQESWHRRYKEEFILQLLHCNLNWKKMEQQAKFFSFDLNKSRVVVLIKLLNPALDNLQHLINYLEQSEFAQDVAILSLDQVVVLKTWQNSTVLSAQMKTLLPADYSKQDYKIAVGACLNLPLFEQLPLSFQSAQSTLSYGLKHHPRKGIYVFDEHRLPVLLAGLSHSWQGNELIKPLSPLFSEENATLYKTLQQYFLSNCDLYLTAEKLFVHPNTLRYRLNKIEQITGLFFNKIDDKLTLYLGTLLEH

SEQ ID NO: 2747 - protein, 106 aa, H. influenzae strain 86-028NP
MSELLINDYTRKGFVDGLCVRLLTICIRPGKPNKATSSFVSSIIREPLHGETSICPVAEKMAFSFIKFLGKKKEEWALAITGYVVSIPIVLPILLIFIKAILDLGK

SEQ ID NO: 2748 - protein, 251 aa, H. influenzae strain 86-028NP
MAKDEVGHNFLARLGKTRLRPGGKKATDWLIANGDFSQDKKVLEVACNMGTTAIGLAKQFGCHIEGVDLDENALAKAQANIEANGLQEKIHVQRANAMKLPFEDESFDIVINEAMLTMLPVEAKKKAIAEYFRVLKPNGLLLTHDVMLVGNDHQTILENMRKAINVTVTPLTKDGWKGIFQESGFRYVDTFSGEMTLLSPKGMIYDEGIFGTLKIIRNAMKAENREQFKRMFKTFNDPEHKLHFIAVCSQK

SEQ ID NO: 2749 - protein, 93 aa, H. influenzae strain 86-028NP
LVEGANQYIGAGNMYNGDVEDLNKPHLYMMSQMEKPTTKAELKSALQGYLIQNEYQDMNNNDKLIDETYDCTELFNALCDVLTRLGYIQPVNL

SEQ ID NO: 2750 - protein, 332 aa, H. influenzae strain 86-028NP
MQFKHFKLATLAAALAFSANSFADITVYNGQHKEAATAVAKAFEQETGIKVTLNSGKSEQLAGQLKEEGDKTPADVFYTEQTATFADLSEAGLLAPISEQTIQQTAQKGVPLAPKKDWIALSGRSRVVVYDHTKLSEKDMEKSVLDYATPKWKGKIGYVSTSGAFLEQVVALSKMKGDKVALNWLKGLKENGKLYAKNSVALQAVENGEVPAALINNYYWYNLAKEKGVENLKSRLYFVRHQDPGALVSYSGAAVLKASKNQAEAQKFVDFLASKKGQEALVAARAEYPLRADVVSPFNLEPYEKLEAPVVSATTAQDKEHAIKLIEEAGLK

SEQ ID NO: 2751 - protein, 506 aa, H. influenzae strain 86-028NP
LPRRPPFWLTLLIILIGLPLCLPFLYVILRATEVGLTRSVELLFRPRMAELLSNTMLLMVCVTIGAISLGTLCAFLLERYRFFGKAFFEVAMTLPLCIPAFVSCFTWISLTFRVEGFWGTIGIMTLSSFPLAYLPVSAILKRLDRSLEEVSLSLGKSPVYTFWYVIFPQLKPAIGSSILLIALHMLIEFGAVSILNYQTFTTAIFQEYEMSFNNSTAALLSAVLMAICILIVFGEIFFRGKQTLYHSGKGVTRPYLVKTLSFGKQCLTFGFFSSIFILSIGVPVIMLIYWLIVGTSLESAGDFSEFLSAFSNSFIISGLGALLTVMCALPLVWAAVRYRSYLTIWIDRLPYLLHAVPGLVIALSLVYFSIHYANDLYQTFFVIIIAYFMLYLPMAQTTLRASLEQLSDQIEKVGQSLGRSPFYIFRTLTLPAILPGVAAAFALVFLNLMKELTATLLLTSNDIKTLSIAVWEHTSDAQYAAATPYALMLVLFSGIPVFLLKKYAFK

SEQ ID NO: 2752 - protein, 351 aa, H. influenzae strain 86-028NP
MINNPLLTVKNLNKFFNEQQVLHDISFSLQRGEILFLLGASGCGKTTLLRAIAGFEHPNTGEIWLKERLIFGENFNLPTQQRHLGYVVQEGVLFPHLNVYRNIAYGLGNGKGKNSEEKTRIEQIMQLTGIFELADRFPHQLSGGQQQRVALARALAPNPELILLDEPFSALDEHLRQQIRQEMLQALRQSGASAIFVTHDRDESLRYADKIAIIQQGKILQIDTPRTLYWSPNHLETAKFMGESIVLPANLLDENTAQCQLGNIPIKNKSISQNQGRILLRPEQFSLFKTSENPTALFNGQIKQIEFKGKITSIQIEINGYAIWIENVISPDLSIGDNLPVYLHRKGLFYA

SEQ ID NO: 2753 - protein, 226 aa, H. influenzae strain 86-028NP
MKLTLEMLTGKSREHLVNLPTTHSSNHFLQTQAMQAFQALQQSAAKNGFNLQPASSFRDFERQKLIWNSKFKGERKVHDDAGKALDLNQLDDWQKCQAILRWSALPGASRHHWGTEVDIFDPDLLPQGQSLQLEPWEYEKGGYFFELSEFLAENLPHFDFALPFMNMQSNKKVGREPWHISYLPLAELASQQFSPEILQQAWKGENILGADCLISHLEQIFSEYIV

SEQ ID NO: 2754 - protein, 377 aa, H. influenzae strain 86-028NP
MREKVVSLAQDLIRRPSISPNDEGCQQIIAERLEKLGFQIEWMPFNDTLNLWAKHGTSEPVIAFAGHTDVVPTGDENQWSSPPFSAEIIDGMLYGRGAADMKGSLAAMIVAAEEYVKANPNHKGTIALLITSDEEAAAKDGTIRVVETLMARDEKITYCMVGEPSSAKNLGDVVKNGRRGSITGNLYIKGIQGHVAYPHLAENPIHKAAPFLQELTTYQWDKGNEFFPPTSLQIANIHAGTGSNNVIPAELYIQFNLRYCTEVTDEIIKQKVAEMLEKHNLKYRIEWNLSGKPFLTKPGKLLDSITSAIEETIGITPKAETGGGTSDGRFIALMGAEVVEFGPLNSTIHKVNECVSIEDLGKCGEIYHKMLVNLLDS

SEQ ID NO: 2755 - protein, 114 aa, H. influenzae strain 86-028NP
MITVYGIKNCDTVKKALKWLADHNIEHKLHDYRVDGLDLNFLTQAETQFGWDVLVNKRSTTWRNLDEQVKNSLDKTTALSVLAENPTLIKRPIILQDEKALIGFNEKEYQAVFA

SEQ ID NO: 2756 - protein, 631 aa, H. influenzae strain 86-028NP
MKEKIMSQNQETRGFQSEVKQLLQLMIHSLYSNKEIFLRELISNASDAADKLRFKALSNPALYEGDGDLRVRVSFDADKGTITISDNGIGMTREQVIDHLGTIAKSGTKEFLTALGQDQAKNSQLIGQFGVGFYSAFIVADKVTVKTRAAGEEADKAVLWESAGEGEYSVADIEKKSRGTDVILHLREDEKEFLNEWRLREIIGKYSDHIGLPVEMLTKEYDDEGKECGEKWEKINKSDALWTRSKNDVSDEEYKAFYKHLSHDFVDPVTWAHNKVEGNQAYTSLLYVPAKAPWDLFNREHKHGLKLYVQRVFIMDDAEQFMPNYLRFMRGLIDSNDLPLNVSREILQDNKITAALRKALTKRSLQMLEKLAKDDAEKYLKFWKEFGLVLKEGPAEDFANKETIAKLLRFASTHNDGSEQTVSLEDYILRMKEGQKAIYYITADSYVAAKNSPHLELFNKKGIEVLLLSDRIDEWMLSYLTEFDGKQLQSITKADLDLGDLADKESETQKQQDKAFGSFIERVKNLLGERVKTVRLTHNLTDTPAVVSTDNDQMTTQMAKLFAAAGQPVPEVKYTFELNPEHYLVKKVADIADETEFADWVELLLEQAMLAERGSLENPAAFIKRINKLLG

SEQ ID NO: 2757 - protein, 279 aa, H. influenzae strain 86-028NP
VHSPTPFALAIFLGILYHIPTFSNQRSIMNNLELEQLINQKLSSDKINDYAPNGLQVEGKTEIKKIITGVTASQALIDYAISQNADAILVHHGYFWKSETPCIRGMKGKRIKALLVNDINLYGYHLPLDVHPELGNNAQLAKLLDIENLQPLEKGTVSIPVWGELKEPMTGKDFAEKIEKVLNRKPLICIENGPHLIRKIGICTGGGQGYIDLAAEQGCDAFITGEVSEQTIHSAREQGLHFFSAGHHATERYGIKALGEWLAKEYGFDVEFKDIDNPA

SEQ ID NO: 2758 - protein, 790 aa, H. influenzae strain 86-028NP
MEHSVHNKLVSFIWSIADDCLRDVYVRGKYRDVILPMFVLRRLDTLLEPSKDAVLEEMRFQKEELAFTELDDLPLKKITGHVFYNTSKWTLKSLYQTASNTPQYMLANFEEYLDGFSTNIHEIINCFKLREQIRHMSHKNVLLSVLEKFVSPYINLTPKEQQDPEGNKLPALTNLGMGYVFEELIRKFNEENNEEAGEHFTPREVIELMTHLVFDPLKDQIPAIITIYDPACGSGGMLTESQNFIEQKYPLSESQGERSIFLFGKETNDETYAICKSDMMIKGDNPENIKVGSTLATDSFQGNHFDFMLSNPPYGKSWSKDQAYIKDGNEVIDSRFKVTLPDYWGNVETLDATPRSSDGQLLFLMEMVSKMKSPNDNKIGSRVASVHNGSSLFTGDAGSGESNIRRHIIEKDLLEAIVQLPNNLFYNTGITTYIWLLSNNKPEARKGKVQLIDASLLFRKLRKNLGDKNCEFVPEHIAEITQNYLDFTAKARETDSQNEAVGLASQIFDNQDFGYYKVTIERPDRRSAQFTAENISPLRFDKALFEPMQYLYRQYGEQIYNAGFLAQTEQEITAWCEAQGIALNNKNKTKLLDVKTWEKAAALFQTASTLLEHFGEQQFDDFNQFKQAVECRLKAEKIPLSATEKKAVFNAVSWYDENSAKVIAKTLKLKPNELDALCQRYQCQADELADFGYYATGKAGEYILYETSSDLRDSESIPLKQNIHDYFKAEVQAHISEAWLNMESVKIGYEISFNKYFYRHKPLRSLAEVAQDILALEKQADGLISEILEA

SEQ ID NO: 2759 - protein, 469 aa, H. influenzae strain 86-028NP
MQPENQYFERKGLGEKDIKPTKIAEELVGMLNADGGVLAFGVADNGEIQDLNSLGDKLDDYRKLVFDFIAPPCRIGLEEILVDGKLVFLFHVEQDLERIYCRKDNENVFLRVADSNRGPLTREQIKNLEYDKNIRLFEDEIVPDFNEEDLDQELLELYKKKVNFTSDNILDLLYKRNLLTKKEGCYQFKKSAILLFSTMPERYIPSASVRYVRYEGTVAKVGTEHNVIKDQRFENNIPKLIEELTYFLRASLRDYYFLDVNQGKFIKVPEYPEEAWLEGVVNALCHRSYNVQGNVIYIKHFDDRLEISNSGPLPAQVTIENIKTERFARNPRIARVLEDLGYVRQLNEGVSRIYESMEKSLLAKPEYREQNNNVYLTLRNRVTAHEKTVSTATMLQIEKEWTNYNDTQKAILLYLFTNGTAILSELVDYTKINQNSIRAYLNAFIQQGIIERQSVKQRDPNAKYAFRKD

SEQ ID NO: 2760 - protein, 416 aa, H. influenzae strain 86-028NP
MRRYERYKDSGVDWLGEVPSHWELKRLKQLFVEKKHKQSLSLNCGAISFGKVIEKSDDKVTEATKRSYQEVLKGEFLINPLNLNYDLISLRIALSEIDVVVSAGYIVLKEKQIINKKYFSYLLHRYDVAYMKLLGSGVRQTINYGHISDSILVIPPLSEQQKIAQFLDDKTAKIDQAVDLAEKQIALLKEHKQILIQNAVTRGLNPDVPLKDSGVEWIGQVPEHWDVQRSKFIFKKIERKVNEEDQIVTCFRDGQVTLRANRRTEGFTNALKEHGYQGIRKGDLVIHAMDAFAGAIGISDSDGKATPVYSVCLPHDKQKIDVYFYAYYLRNLALSGFISSLAKGIRERSTDFRYSDFAELLLPIPPYLEQQKIADYLDKQTSKIDRAIALKTAHIEKLKEYKSVLINDVVTGKVRV

SEQ ID NO: 2761 - protein, 1008 aa, H. influenzae strain 86-028NP
MVSGTKEKDLEIAIEKALTGTWRENMENKLGEPKAEYLPRHHGFKLAFSQDFDAQFAIDTRLFWQFLQTSQEAELARFQQLNPNDWQRKILERLDRQIKKNGVLHLLKKGLDIDSAHFDLLYPVPLASSGEKVKQRFEQNLFSCMRQVPYSASSNETVDMVLFANGLPIIALELKNHWTGQTAIDAQKQYLNRDLSQTLFHFGRCLAHFALDTEEAYMTTKLAGPATFFLPFNLGNNCGKGNPPNPNGHRTAYLWQEVFGKASLANIIQHFMRLDGSTKDPLDKRTLFFPRYHQLDVVRRLIADVSEHGVGKRYLIQHSAGSGKSNSITWLAYQLIEAYPRNEKAANGREADRPIFDSVIVVTDRRLLDKQLRDNIKDFSEVKNIVAPALSSAELRQSLEQGKKIIITTIQKFPFIVDGIADLGDKQFAVIIDEAHSSQSGSAHDNMNRAIGKTEDLDAEDVQDLILQTMQSRKMHGNASYFAFTATPKNSTLEKFGEKQADGKFKPFHLYSMKQAIEEGFILDVIANYTTYKSFYEITKSIEDNPEFDSKKAQSRLKAYVERSQQTIDTKAEIMLDHFIYQVFNRKKLKGKAKGMVVTQNIETAIRYFQALKHLLAGRGNPFKIAIAFSGSKVVDGVEYTEAEMNGFAESETKEYFDQDEYRLLVVANKYLTGFDQPKLCAMYVDKKLSGVLCVQALSRLNRSANKLSKRTEDLFVLDFFNSVEDIQQAFEPFYTSTSLSQATDVNVLHDLKDRLDETGVYEQAEVNDFTEGYFANKDAQQLSSMIDVAVQRFDDELELDLDRNEKVDFKIKAKQFLKIYGQMASIINFENIAWEKLYWFLKFLVPKLKVQDPMDEFDEILDAVDLSSYGLARTKLNYSIKLDDEETELDPQNPNPRGTHGEDKEKDPIDEIIRVFNERWFQDWSATPDEQRVKFINITERIRSHKDFEQKYQNNPDIHTRELAFQAILRDVMSERHRDELELYKLFAKDAAFRTAWTQSLQRALAG

SEQ ID NO: 2762 - protein, 459 aa, H. influenzae strain 86-028NP
MFENLSDRLSKTLRNITGKGRLTEDNIKETLREVRMALLEADVALPVVREFIAKVKESALGEEVNKSLTPGQEFLKIVQRELEKAMGEANESLNLATQPPAVILMAGLQGAGKTTSVGKLAKFLRERHKKKVLVVSADVYRPAAIKQLETLAQSVGVDFFPSDVKQNPVDIAKEALADAKLKFYDVLIVDTAGRLHVDTEMMDEIKQVHAALNPIETLFTVDAMTGQDAANTAKAFNEALPLTGVILTKVDGDARGGAALSIRQITGKPIKFLGVGEKTEALEPFHPDRVASRILGMGDVLSLIEDLERSVDREKAEKMAQKFKKGDDFTLDDFREQLIEMKKMGGMMSMLEKLPGAKNLPEHVKNQVDDKMFVKMEAIINSMTLKERANPDIIKGSRRRRIALGSGTQVQDVNKLLKQFDEMQRMMKKMRKGGMAKMMRGMQGLMGGGLGGLGGMFKR

SEQ ID NO: 2763 - protein, 430 aa, H. influenzae strain 86-028NP
LLINEQKDFPLDSIPLSTLFIILIICLVLSAYFSGSETGLLSLNKYRLRFLSEQGNKGAKKAEKLLEKPDTLLSFILIFNNLVNISASAIATVIGMRLYGDAGVAIATGLLTFVMLVFSEIFPKTVAAMHAEKVSFFSSHILTSLLKIFYPLVWLMNIFTKSLMQIVGLKLDMQKQVISSEELRSIVSEAGEATPNEQHPQMLLSILDMETVTVDDIMVPRNEIGGINIDDDWRAIMRQLNHAAHNRVVLYKGSLDEQVLGILRVREAFRLLLEKNEFTKETLIRAADEVYFIPESTPLKTQLANFRTNKERIGLVVDEYGDIKGLVTLEDILEEIVGDFTTSTAPSIDKEVIQQSDGSMIIDGSANLRDLNKMFNWELDTEDARTFNGLILEHLEEIPDEGTICEIDGLLITILEVGDNMIKQAKVVKL

SEQ ID NO: 2764 - protein, 292 aa, H. influenzae strain 86-028NP
LNRTFDLDHKCGSFFAHFLEKIFIILSRYILIEKKDMEHEYQRAVTRVCVQTALLLLQHGAESTVVVQMAQRLGVALGVESVECALTANAVVLTTLSDNHCITTARKNTDKGINMQMVTDVQRIVIAVEHHLYELEIVQRKLDQLKPLKYNRWLVVFMIGLSCAAFAHLSGGDWIICSITFVAAAIAMFVRQEFSKRHYNPLIVFSITSFVASLISGVSLKYNLGNDPQIALASSVLLLVPGFPLINSLADILKGYVNMGLGRWTIATVLTFGACLGIVFALSLLHITTWGH

SEQ ID NO: 2765 - protein, 159 aa, H. influenzae strain 86-028NP
MLSDITIFILKLLDDMLCAAIPAVGFALVFNVPPKALKYCAILAALGHVTRTLLLHINMPIVFATFFATCVIGFLGVHLSHRYLAHPKAFTVAAIIPMIPGVHAYKAMISMVQIHHFGFSDALFEQMISSFINTSFILGAIVFGLALPGLLFYRQKPVV

SEQ ID NO: 2766 - protein, 113 aa, H. influenzae strain 86-028NP
MVKIERKATDSAYHEFTKILTSSAQLVAFLNQSDFVKARAKVENETVQQIASHFKFSQENNLNQLILSSFDRKEEDQLFVEYIRYVNNQARQTLNNELITKWKSLFEKRKITD

SEQ ID NO: 2767 - protein, 429 aa, H. influenzae strain 86-028NP
MIDPNLLRNNLAEVAEKLKVKRNFMLDTEKLTALEDQRKNLQVTTENLQAERNARSKAIGAAKVRGEDIAPLLAEMDDMGNQLTEAKAQLDAVLAEINQIALSIPNLPADEVPLGKDDTENKEILRWGTPHTFDFEVKDHITLGEEANGLDFAAGAKLAGARFAVMKGQIAKMHRALAQFMLDLHTEQHGYLETYVPYLVNHATLYGTGQLPKFGEDLFHTLALEGEQPYALIPTAEVPVTNLVRDVIIDEAELPIKMTAHTPCFRSEAGSYGRDTRGLIRMHQFDKVEMVQIVDPDKSMEALEELTGHAEKVLQLLNLPYRKVLLCTGDMGFGSCKTYDLEVWLPAQNTYREISSCSNMWDFQARRMQARCKAKGDKKTRLVHTLNGSGLAVGRTLVAVLENYQNADGSITVPEELRPYMGGLDVIGK

SEQ ID NO: 2768 - protein, 209 aa, H. influenzae strain 86-028NP
MKLYGLIGACSFVPHVALEWVKIRENADYEFEPVTRELIKSPEFLSLNPRGAVPVLVDGDLVLSQNQAILHYLDELYPNSKLFGSKTVRDKAKAARWLAFFNSDVHKSFVPLFRLPNYAKDNETLAHTIRQQAVEQILDQLAVANEHLESHIYFGEDISVADAYLYIMLNWCRAVGIDFSHLTQLSAFMQRVETDQAVENVRKSEELKV

SEQ ID NO: 2769 - protein, 98 aa, H. influenzae strain 86-028NP
MIKARYFYLYKLIVRCRFFIAKYNTLFKQQVIEFYIQNGKNYSLISKHFQLDSRTLRHWINQFNHSRINWLAVLGKKRNYSLKFKLNVIQTVKNGQFL

SEQ ID NO: 2770 - protein, 745 aa, H. influenzae strain 86-028NP
MNILINKRIFLLVTLVGIQLNVTAKQNSSNSNREELLPIIVNTNDDSNKLPGRSVLKQKNIEQQQADNAANLINILPGVNMAGGFRPGGQTLNINGMGDAEDVRVQLDGATKSFEKYQQGSIFIEPELLRRVTVDKGNYSPQYGNGGFAGTVKFETKAARDFLQENQKIGGFLKYGNNSNNNQKTYSTALVLQNEQKNIDLLLFGSVRNAGDYKRPDNSKILFSKNNQKTGLIKVNWQISPEHLLTLSSVYGIHKGWEPFAAKRDILPKPSSGDIMRYGADIAWKRKLVYRDQKDKNYTLKYNYLPENNPWINLSTQFSYSKTTQNDTRPEKAPPVFLGTLGNQSWITYSDLTFDINNTSTFNIKSTRHELLFGLQWLKNTRNTLMYDKSKVKKEDYNYGYFQPYYMPSGRQYTQALYLQDQITWKNIIFSTGVRYDHINNIGQKNFAPQYNDISVGQNYSQKNYNGWSYYLGLKYDVNHYLSLFTNFSRTWRAPVIDEQYETQYKQSSGPVTATSLNLEKEMINQTRVGGIITLNHLFQENDVFQFRTTYFYNRGKNEIFKTRGVNCVGNAADTNHVCPKIIGNYRNLPGYVIQGAELEAYYQSTYLFGEITYSYVKGKRDTSPRNPWGKTSTWIAEIPPRKATTALGFNIPKYNFTAGWRAEFVRRQDRSPLSGDPEAKYWSLPASRGYSLHNLFLSWSPAKIKGMNIKITVDNLFNRAYNPYLGELASGTGRNIKFSLSQKF

SEQ ID NO: 2771 - protein, 711 aa, H. influenzae strain 86-028NP
MKQLFATTSRGFEELLKVELTELGAQEAKVVQGGVHYQADDETLYRTLLWSRLASRILFPLIETKIYSDLDLYAAVSGFNWLGLFDERVTFFVDFNGTNQEIRHTQFGAMRVKDGIVDYFERQGKARPDVDKIQPDVRIHAYLNRENLVISLDLSGEALHLRGYREDAGQAPLRETLAAAIVLRSGWQVGSPLVDPMCGSGTLLIEAAQMEAKIAPQLYRLHWGFDFWKAHNQSAWEKVKNEAIELAEEKQREIQPHFYGFDLDHRVLKKAQKNAQNAGVSHLIKWQQGDVAALKNPRLNEVGTVICNPPYGERLGTTPALIALYSVFGQRLKKEFCGWNVSVFSSESTLLDCLRMRASRQFKAKNGPLDCVQKNYQVSERKSDEITAENELEFNRTSEVATDFANRLQKNIKKISKWAKQQGLDAYRLYDADLPEYNLAVDRYADYIVVQEYAAPKNIDENKARQRLLDAVTATLHVTGVETNKLILKVRQKQKGTNQYEKLANKGEYFYVNEYGAQLWVNLTDYLDTGLFLDHRLTRKMIGALAKGKDFLNLFAYTGSATVHAALGGAKSTTTVDMSNTYLNWAEQNLILNDIEGKQHKLIQADCLQWLEKCDRQFDLIFVDPPTFSNSKRMEDSWDVQRDHVKLMRNLKRVLSNNGTIVFSNNKRGFKMNLVALEELGLSAVEISHKTLPLDFERNKQIHNCWMIQHI

SEQ ID NO: 2772 - protein, 369 aa, H. influenzae strain 86-028NP
MSVCKPFWFKTFSISIITALLVSCTSNIKNIQIPTTLNGSDPQQFGAKYTNRTYQQAALVPVSNIENQSAVINQGDFLTQLSNIKNYSSKLSTNFYDNYEKITNWVLSGANINELTQFNIHPQIMRGFDGYQNVLMTGYYSPILYARHTPQGQFKNPIYRMPVKKRLSRAQIYAGALTGKRLELAYSDSMLENFLLGVQGSGYVDFGDGNLNYFAYAGQNGYPYTAIGRLLVEDGEIPKEKMSIQAIREWGNRNPSRVQSLLERNEAYVFFKNDPSGKVKGSAGVPLVAMASVASDRNIIPSGSVLLVEVPDIDNNGNWIGTHKLHLMVALDVGGAVKGHHFDLYRGIGARAGHIAGLSKHYGRVWVLR

SEQ ID NO: 2773 - protein, 256 aa, H. influenzae strain 86-028NP
MARIDNYEQRFGGIGRLYTPDGLARLRQAHICVIGIGGVGSWVVEALARSGICELTLIDMDDICVTNINRQLPAMSGTIGKLKTEVMSERVKLINPECTVNIIDDFISPENQSDYLNRGYDYVIDAIDNVKTKASLIAYCKRNKINVITIGGAGGQTDPTQIQIADLSKTIQDPLLAKVRSVLRKDYNFSQNPKRKFSIDAVFSTQPLIFPQMTEGCSTSATMNCANGFGAATMITATFGFFAVSRVIDKLLKKKS

SEQ ID NO: 2774 - protein, 333 aa, H. influenzae strain 86-028NP
MKKLLKISAVSAALLSAPMMANADVLASVKPLGFIVSSIADGVTGTQVLVPAGASPHDYNLKLSDIQKVKSADLVVWIGEDIDSFLDKPISQIERKKVITIADLADVKPLLSKAHHEHFHEDGDHDHKHKHKHDHKHDHDHDHKHEHKHDHEHHDHDHHEGLTTNWHVWYSPAISKIVAQKVADKLTAQFPDKKALIAQNLSDFNRTLAEQSEKITAQLANVKDKGFYVFHDAYGYFNDAYGLKQTGYFTINPLVAPGAKTLAHIKEEIDEHKVNCLFAEPQFTPKVIESLAKNTKVNVGQLDPIGDKVTLGKNSYATFLQSTADSYMECLAK

SEQ ID NO: 2775 - protein, 168 aa, H. influenzae strain 86-028NP
MADPHIKSPMDFLDYLTVIIYRTGFVIAALAVLTVSWYPDLSLTFILIAATCCASSLHIYLKSFRLLFQFATWIGLLFYINHYPALALGGALLTLGGLCFKEYFCFRVPLLNLQPIFVACLWFSWVLNNLIALRIFSIISGVLLLVLAIQKWRMPLHFDIGDKTKYQI

SEQ ID NO: 2776 - protein, 452 aa, H. influenzae strain 86-028NP
MKHIHILGICGTFMGGVAMIAKQMGYHVTGSDTNVYPPMNTFLEEQGIEIIPNYDVAQLQPAPDMVIVGNAMKRGNPCVEYVLENNLKYTSGPQWLHDHLLRDRWVLAISGTHGKTTTTGMLTWILEQNGLKPGFLIGGIAGNFGISARLGDSPYFVIEADEYDTAFFDKRSKFVHYNPRTLIVNNISFDHADIFDDLKAIQRQFHHMIRTIPASGLVLSSASEQSAKETLALGCWSQQQFLGKDNEWFAERITNDASHFAVFHHGEKVAEVKWNVVGQHNMHNALMAIAAAHHTGVAIEDACKALGSFVNAKRRLEVKGEVNGITVYDDFAHHPEAILATLTALRDKVGGVRILAVLEPRSNTMKMGVHKDDIAPALGRADAVFMLQPEQLSWEVADIANQCVQPAYWNANLDRLVDMIVAEAQPTDHILVMSNGSFGGIHQKILDKLKLK

SEQ ID NO: 2777 - protein, 395 aa, H. influenzae strain 86-028NP
MQQHNLSTTFVHAGRQKRFSQGSVNPVLQRASSLLFDSIEDKKHATQRRAKGELFYGRRGTLTHFALQDLMCEMEGGAGCYLYPCGTAAVTNSILSFVKTGDHVLMSGAAYEPTQYFCNIVLKKMQIDITYYDPLIGADIATLIQPNTKVLFLEAPSSITMEIPDIPTIVKAARKVNPNIVIMIDNTWSAGVLFKALEHDIDISIQAGTKYLVGHSDIMIGTAVANARTWDQLREHSYLMGQMVDADSAYTTARGIRTLGVRLKQHQESSIKVAKWLSEQPEVKTVYHPALPSCPGHEFFLRDFSGSSGLFSFELTQRLTSEQVSKFMDHFQLFAMAYSWGGFESLILCNQPEEIAHIRPNIKRNLTGSLIRVHIGFENVDELIADLKAGFERIA

SEQ ID NO: 2778 - protein, 202 aa, H. influenzae strain 86-028NP; identical to SEQ ID NO: 703

SEQ ID NO: 2779 - protein, 185 aa, H. influenzae strain 86-028NP
MKFNIPIFLTIFRVILIPFFVIAFYLPIESSPFITTLIFFIAGVTDWLDGYLARKWKQTTRFGAFLDPVADKVMVVAALVLIVEHQHTFWITIPAIIMISREIIISALREWMAELGERSKVAVSWWGKWKTTAQMLALGGLLWRYNNYMEIAAIILLYIAAILTIWSMIQYLQVAKGSLLDNIQL

SEQ ID NO: 2780 - protein, 176 aa, H. influenzae strain 86-028NP
MADFNQILTPGDVDAGIINVVNEIPEGSCHKIEWNRKVAAFQLDRVEPAIFAKPTNYGFIPQTLDEDGDELDVLLITRQPLATGVFLEAKVIGVMKFVDDGEVDDKIVCVPADDRDTGNAYNSLADLPANLIKQIEFHFNNYKALKKPGSTKVTHWGDVEEAKEVIRESIKRWNER

SEQ ID NO: 2781 - protein, 438 aa, H. influenzae strain 86-028NP
MPTLEKTFELKQRGSTVRQEIIAGLTTFLAMVYSVIVVPNMLGAAGFPAESVFIATCLVAGLGSILIGLWANAPMAIGCAISLTAFTAFSLVIGQKVAIPVALGAVFLMGVVFTLISTTGIRAWILRNLPSNIAHGAGIGIGLFLLLIAANGVGLVVSNQAGLPVKLGDFTSFPVMMSLIGLALIIGLEKMKIKGGILWVIIAITIVGLIFDPNVKFGGEIFKMPTFGENSLFLQLDFMGALQPAILPVVFALVMTAVFDATGTIRAVAGQADLLDKDGQIINGGKALTSDSISSLFSGLFGTAPAAVYIESAAGTAAGGKTGITAIVVGVLFLLMLFFQPLAFLVPGYATAPALMYVGLLMLSNVSKLDFDDFVGAMSGLICAVFIVLTANIVTGIMLGFAALVIGRIVSGDIKRLNVGTVIIAIVLVAFYAGGWAI

SEQ ID NO: 2782 - protein, 213 aa, H. influenzae strain 86-028NP
MSNPSCIIIAITGASASGKSSIASTVHKELCNELGCQEIGIITEDSYYKDQSHLEMTERVKTNYDHPNSMDRDLLIQHLKNLKNGSAVDVPVYSYVEHTRTNETTHFTPKRIVILEGILLLTDERVRQLADISVFVDTPLDICFIRRLQRDMEERGRSLQSVIDQYRATVRPMFLQFIEPSKQYADIVIPRGGKNRIAINMLKAQILHLLNQK

SEQ ID NO: 2783 - protein, 195 aa, H. influenzae strain 86-028NP
MRLCDTDIERYLDDGIISLTPRPNNDKINGATIDVRLGNSFRVFREHSAPFIDLSGPKEEVSAQLESVMSDEILIPEGEAFFLHPGTLALATTLESVKLPANIIGWLDGRSSLARLGLMVHVTAHRIDPGWEGKIVLEFYNSGKLPLALRPNMVIGALSFEVLSGEAKRPYSSRKDAKYKNQQSAVASRIDEDKE

SEQ ID NO: 2784 - protein, 391 aa, H. influenzae strain 86-028NP
MKKFALIVGIVALAIFSFLYIQLYRVQSAINEQLAQQNIAVQSINLSLFSPALSLENLKTTQFSAQKIEAKFSFLPLLYGNAALHSLNIQQLKLTQNTQNPANVSIEVSPFSLKQLLSKKVILNGENHIRIEFNKPIYGKTKTFHFSFHKANLDFSTSESTPLQFVDASLNNQPIGYIESHTAHQQIVTYIKPQCDNDCLAVLKYQQIDNQSAVNFSGKYFPVQRLFALLNLPEILSGHADFDLDFSFSSSALIQGKLNFLAQNGEILGVNLLDMVAQYFPINYNNDLLQNKELNTRFEQFYLQLFLQQNQLIAEKIELKTPALLGQGKGIIDLNRMECNVDINLNSTDQRYQNLTLPINFFGNCNSPQYKINFTKKFRHQLIDAIKEKLR

SEQ ID NO: 2785 - protein, 402 aa, H. influenzae strain 86-028NP
MSLYLKAEKIQSWRVLIMACAGFIFNTTEFVPVAMLSDIAQSFDMQTADTGLMMTVYAWTVLIMSLPAMLATGNMERKSLLIKLFIIFIVGHILLVIAWNFWILLLARMCIALAHSVFWSITASLVMRISPKHKKTQALGMLAIGTALATILGLPIGRIVGQLVGWRVTFGIIAVLALSIMFLIIRLLPNLPSKNAGSIASLPLLAKRPLLLWLYVTTAIVISAHFTAYTYIEPFMIDVGHLDPNFATAVLLVFGFSGIAASLLFNRLYRFAPTKFIVVSMSLLMFSLLLLLFSTEAIIAMFSLVFIWGIGISCIGLSLQMRVLKLAPDATDVATAIYSGIFNAGIGAGALFGNLATTYLGLNEIGYTGAALGLIGFIIFITTHLKYRHTFLLQNNKKITAL

SEQ ID NO: 2786 - protein, 504 aa, H. influenzae strain 86-028NP
MATPVVALVGRPNVGKSTLFNRLTRTRDALVADFPGLTRDRKYGHAHIAGYDFIVIDTGGIDGTEEGVEEKMAEQSLLAIDEADIVLFLVDARAGLTAADIGIANYLRQRQNKITVVVANKTDGIDADSHCAEFYQLGLGEIEQIAASQGRGVTQLMEQVLAPFAEKMENADENDRTSEEEQDEWEQEFDFDSEEDTALIDDALDEELEEEQDKNIKIAIVGRPNVGKSTLTNRILGEDRVVVFDMPGTTRDSIYIPMERDGQQYTLIDTAGVRKRGKVHLAVEKFSVIKTLQAIQDANVVLLTIDARENISDQDLSLLGFILNAGRSLVIVVNKWDGLDQDVKDRVKSELDRRLDFIDFARVHFISALHGSGVGNLFDSIKEAYACATQKMTTSLLTRILQMATDEHQPPMIGGRRIKLKYAHPGGYNPPIIVVHGNQMDKLPDSYKRYLSNYYRKSLKIIGSPIRLLFQEGSNPFAGRKNKLTPNQLRKRKRLMKFIKKAKR

SEQ ID NO: 2787 - protein, 255 aa, H. influenzae strain 86-028NP
MINPNRQIVLDTETTGMNQLGAHYEGHCIIEIGAVELINRRYTGNNFHIYIKPDRPVDPDAIKVHGITDEMLADKPEFKDVAQDFLDYINGAELLIHNAPFDVGFMDYEFRKLNLNVKTDDICLVTDTLQMARQMYLGKRNNLDALCERLGIDNSKRTLHGALLDAEILADVYLMMTGGQTNLFDEESVESEVIHVMQEKTAEEIKSAVDFSHNLKLLQPTNDELQAHLEFLKMMNKKSGNNCLWEKRFGNNNVH

SEQ ID NO: 2788 - protein, 154 aa, H. influenzae strain 86-028NP
MQKQIEIFTDGSCLGNPGAGGIGAVLRYKQHEKMLSKGYFKTTNNRMELRAVIEALNTLKEPCLITLYSDSQYMKNGITKWIFNWKKNNWKASSGKPVKNQDLWIALDESIQRHKINWQWVKGHAGHRENEICDELAKKGAENPTLEDMGYIEE

SEQ ID NO: 2789 - protein, 365 aa, H. influenzae strain 86-028NP
MKKTLAALIVGAFAASAANAAVVYNNEGTNVELGGRLSIIAEQSNSTIKDQKQQHGALRNQSSRFHIKATHNFGDGFYAQGYLETRLVSAQSGTESDNFGHIITKYAYVTLGNKALGEVKLGRAKTIADGITSAEDKEYGVLNNSKYIPTNGNTVGYTFKGIDGLVLGANYLLAQERHKYTTAAGTRAVTVAGEVYPQKISNGVQVGAKYDANNIIAGIAYGRTNYREDIVDPDLGKKQQVNGALSTLGYRFSDLGLLVSLDSGYAKTKNYKDKHEKSYFVSPGFQYELMEDTNVYGNFKYERDSVDQGKKTREQAVLFGVDHKLHKQVLTYIEGAYARTRTTEQAKGVKTEKEKSVGVGLRVYF

SEQ ID NO: 2790 - protein, 381 aa, H. influenzae strain 86-028NP
MKYALTNSVIYTKYEILRDYAVVIDSETIEAVIPQAELETGIKTIDLQGNNLTAGFIDLQLNGCGGVMFNDQTSVETLEIMQETNLKSGCTSFLPTFITAPDENIKSAVKIMREYLNKHKNQALGLHIEGPYLSIEKKGVHRPEYIREITPEMKDFLCENGDVITKITIAAENPTINYTPDFVKAGIIVSVGHSNATYEVAKAAFHKGATFATHLHNAMSPISSGREMGVVGAVLDSDVYTGIIVDGVHINYGNVRIDKKIKGDKLCIVTDSIAAAGAPPELENFTFVGKTIYIKDGRCYDANGTIAGASITMMESIKNAVEYVEIPLAEAIRMSNLYPARAIGIDDRLGSVEKGKIANLAVFTPNYQVIGTVVNGKWKEN

SEQ ID NO: 2791 - protein, 270 aa, H. influenzae strain 86-028NP
MRFIPLQTEQQVSCWAAQHIINRINDFKPTAERPFVLGLPTGGTPLKTYQELIRLYQAGKVSFKHVVTFNMDEYVALPEEHPESYHSFMYNNFFNHIDILPENINILNGNTDDHNAECHRYEEKIKSYGKIHLFMGGVGVDGHIAFNEPASSLSSRTRIKTLTQDTLIANSRFFNNDVTQVPKYALTIGVGTLLDAEEVMILATGHQKALAVQAAVEGSINHLWTVSALQMHRHFVLVCDEAAQQELKVKTVKYFTELEGSVAGTDYQDK

SEQ ID NO: 2792 - protein, 293 aa, H. influenzae strain 86-028NP
MRDLKGIFSALLVSFNEDGTINEKGLRQIIRHNIDKMKVDGLYVGGSTGENFMLSTEEKKEIFRIAKDEAKDQIALIAQVGSVNLKEAVELGKYATELGYDCLSAVTPFYYKFSFPEIKHYYDTIIAETGNNMIVYSIPFLTGVNMGIEQFGELYKNPKVLGVKFTAGDFYLLERLKKAYPNHLIWAGFDEMMLPAASLGVDGAIGSTFNVNGVRARQIFELTKAGKLAEALEIQHVTNDLIEGILANGLYLTIKELLKLEGVDAGYCREPMTSKATAEQVAKAKDLKAKFLS

SEQ ID NO: 2793 - protein, 288 aa, H. influenzae strain 86-028NP
MAKLGNVLNKIGSLYQSLTKSEKKIADTILRSPDLVSQCSLSEIAKHLQVGEATLVRFCRTIGFKGFSEFKLELSIELATKDNQDESILETEIMPSDDSLTIAQKLQTAVANVMEETINLLDLKQLEEVVKVLKKARRIFLFGVGSSGVTAEDAKNKLMRIGFQVDASGNNHFMYMQAALLTSSDVAIGLSHSGYSAETAHTIKIAKQNGATTVALTHSLRSPVTEYADYVLVNGNKQGKLQGDSIGTKIAQLFVLDLIYALLVQGEEEIAAQTKQKTLNVILEQRIK

SEQ ID NO: 2794 - protein, 300 aa, H. influenzae strain 86-028NP
MRCLALDIGGTKIAAAIVKNGEIEQRQQIHTPRENVVEGMHQALGKLLADYEGQFDYVAVASTGIINNGILSALNPKNLGGLAEFPLKASIAKHTDKPIGLLNDAQAATYAEYQLQNFEQVSNFVFITVSTGVGGGIVLNQILQTGSRGIAGHIGHTLADPNGAICGCGRRGCVEAIASGRAIEAVSSQWEDPCDPKEVFERFRKNDEKATALVERSAKAIANLIADLVISLDIQKIAIGGSVGLAEGYLSLVEKYLQDFPSIYCCEIETAKFGQDAGLIGAAYWVKDVLLDKPEGTIYG

SEQ ID NO: 2795 - protein, 228 aa, H. influenzae strain 86-028NP
MSKLSYQEVLSQIQYGLISSCQPVDDGPMDKPEIVSAMAQASVMGGASGLRIEGVDNLKATRPFVNVPIIGIVKRDLPDSPVRITPFLQDIEDLANAGADIIAVDGTSRPRPVDIESAVKKIHEMGCLAMADCSNLEEGLYCKALGFDIVGSTMSGYTGGAVPEEPDYQLVKDLKSAGCFVMAEGRYNTPELAKVAIEIGADCVTVGSALTRLEHIVSWFANSVKSAR

SEQ ID NO: 2796 - protein, 329 aa, H. influenzae strain 86-028NP
MMKLTKLFLATAISLGVSSAVLAADYDLKFGMNAGTSSNEYKAAEMFAKEVKEKSQGKIEISLYPSSQLGDDRAMLKQLKDGSLDFTFAESARFQLFYPEAAVFALPYVISNYNVAQKALFDTEFGKDLIKKMDKDLGVTLLSQAYNGTRQTTSNRAINSIADMKGLKLRVPNAATNLAYAKYVGASPTPMAFSEVYLALQTNAVDGQENPLAAVQAQKFYEVQKFLAMTNHILNDQLYLVSNETYKELPEDLQKVVKDAAENAAKYHTKLFVDGEKDLVTFFEKQGVKITHPDLVPFKASMKPYYAEFVKQTGQKGEAALKQIEAINP

SEQ ID NO: 2797 - protein, 616 aa, H. influenzae strain 86-028NP
MKYINKLEEWLGGTLFIAIFGILIAQILSRQVFHSPLIWSEELAKLLFVYVGMLGISVAVRKQEHVFIDFLTNLMPEKIRKFTNTFVQLLVFVCIFLFIHFGIRTFNDASFPIDALGGISEKWIFAALPVIAILMMFRFIQAQTINFKTGKSYLPATFFIISAVILFAILFFAPDWFKVLRISNYIKLGSSSVYIALLVWLIIMFIGVPVGWSLFIATLLYFSMTRWNVVNAATEKLVYSLDSFPLLAVPFYILTGILMNTGGITERIFNFAKSLLGHYTGGMGHVNIGASLLFSGMSGSALADAGGLGQLEIKAMRDAGYDDDICGGITAASCIIGPLVPPSIAMIIYGVIANESIAKLFIAGFIPGVLITLALMAMNYRIAKKRGYPRTPKATREQLCSSFKQSFWAILTPLLIIGGIFSGLFSPTESAIVAAAYSIIIGKFVYKELTLKTLFNSCIEAMAITGVVALMIMTVTFFGDMIAREQVAMRVADVFVAVADSPLTVLVMINALLLFLGMFIDALALQFLVLPMLIPIAMQFNIDLIFFGVMTTLNMMIGILTPPMGMALFVVARVGNMSVSTVTKGVLPFLIPVFVTLVLITIFPQIITFVPNLLIP

SEQ ID NO: 2798 - protein, 379 aa, H. influenzae strain 86-028NP
MGFIMKLTKTALCTALFATFTFSANAQTYPDLPVGIKGGTGALIGDTVYVGLGSGGDKFYTLDLKDPSAQWKEIATFPGGERNQPVAAAVDGKLYVFGGLQKNEKGELQLVNDAYRYNPSDNTWMKLPTRSPRGLVGSSGASHGDKVYILGGSNLSIFNGFFQDNVAAGEDKGKKDEIVAAYFDQRPEDYFFTTELLSYEPSTNKWRNEGRIPFSGRAGAAFTIQGNDLVVVNGEIKPGLRTAETHQGKFTAKGVQWKNLPDLPAPKGKSQDGLAGALAGYSNGYYLVTGGANFPGSIKQFKEGKLHAHKGLSKAWHNEVYTLNNGKWSIVGELPMNIGYGFSVSYNNKVLLIGGETDGGKALTSVKAISYDGKKLTVE

SEQ ID NO: 2799 - protein, 144 aa, H. influenzae strain 86-028NP
MLFIPPPLLCLFIAIAMYFLPKIASYSVHFSVIVFVISLSFLIALSSVMQFFICKTSINPRDFKGTTKLVSTGIFRFSRNPMYLSLLLILLAWTLWLGNSLAWLGVIVFILVMNHCQIAREEAYLENKFGDEYRRYKQKVRRWL

SEQ ID NO: 2800 - protein, 295 aa, H. influenzae strain 86-028NP
MRRFLLPVIFVIAAVVYSSIVVVTEGTRGIMLRFNKVQRDADNKVVVYEPGLHFKVPLIDSIKVLDARIRTLDGSATRFVTVEKKDLLVDSYVKWKISDFGRFYTSTGGGDYAQAANLLSRKVNDRLRSEIGSRTIKDIVSGTRGELMEGAKKALSSGQDSTAELGIEVIDVRVKQINLPDEVSSSIYQRMRAERDAVAREHRSQGKEKAAFIQADVDRKVTLILANANKTAQELRGSGDAAAAKLYSDAFAQEPQFFTFVRSLKAYEASFANSDNIMILKPDSDFFRFMQAPKK

SEQ ID NO: 2801 - protein, 410 aa, H. influenzae strain 86-028NP
MENEMSQNGSDRDPWSKPGQSNDQQPGNSSNNNGWNNNQNRGNQEQSPPDIEEIFNNLLKKLGGGNKKSGQNNGSSQGNTPFHFGKVIPLAVAIGAIIWGVSGFYTIKEAERGVVLRFGELHSIVQPGLNWKPTFVDKVLPVNVEQVKELRTQGAMLTQDENMVKVEMTVQYRVQDPAKYLFSVTNADDSLNQATDSALRYVIGHMSMNDILTTGRSVVRENTWKALNEIIKSYDMGLEVIDVNFQSARPPEEVKDAFDDAIKAQEDEQRFIREAEAYAREKEPIARGDAQRILEEATAYKDRIVLDAKGEVERLQRLLPEFKAAPDLLRERLYIQTMEKVMANTPKVMLDGNNGNNLTVLPLEQIMGKKSVTSAPSAVNSSPAFTAPERQNSYQPQPTTVAPIRQGRFN

SEQ ID NO: 2802 - protein, 235 aa, H. influenzae strain 86-028NP
MTTYIAYGNINQPFSLESLPDELIPENLYQIETDSSRVFQRHQCRRLAHLLLFQLLKIAGKSTALLSQIHRTESGRPYFLDERIDFNISHSGDWVAVILDIRKEEKSAVGIDIEFPKIRNFTALMEHIAPKEEIDWFHHQQDSLNAFYRCWCLREAVLKSQGFGIVKLSNVRHFPEQQKIFSDYCPQGQLWFTDELPIYLAAFVNHQEKLPHFYEWNRESLQIKELEKYVLYEVN

SEQ ID NO: 2803 - protein, 443 aa, H. influenzae strain 86-028NP
MLYLEFLFLLLMLYIGSRYGGIGLGVVSGIGLAIEVFVFRMPVGKAPIDVMLIILAVVTCASVLEAAGGLKFMLQIAERILRKNPKRVTLLGPLVVYLLTFMLGTGHSVYTIMPIIGDVALKNKIRPERPMAASSVASQLAITSSPLSAAVVFYLGKITAMPAFEHISLLDIICVTVPATLAGTIALSLYSMRRGKELEQDPEYQRRLQDPVWRERILNTTSTTLNETLPQGAKKSVYLFLLALVVIVAIAMIPEIRTIGSGKAISMSLIIQMMMLCFGGVILLATKTNPQIVQNGVVFKSGMVAAIAIYGIAWMSDTYFKYAMPEFKAAITDMVQTYPWTFALALFAVSVVINSQAATAVMLLPVGIGLGIPAPILVGLMPATYAYFFIPNYPSDIATVNFDVTGTTKIGKYYFNHSFMVPGLIGVVVACLVGVSVAELVIR

SEQ ID NO: 2804 - protein, 76 aa, H. influenzae strain 86-028NP
MSIEERVKKIIVEQLGVKEEDVKPEASFVEDLGADSLDTVELVMALEEEFDIEIPDEEAEKITTVQSAIDYVQNNQ

SEQ ID NO: 2805 - protein, 242 aa, H. influenzae strain 86-028NP
MQGKIALVTGASRGIGRAIAEELSSKGAFVIGTATSEKGAEAISAYLGDKGKGLVLNVTDKESIETLLEQIKNDFGDIDILVNNAGITRDNLLMRMKDEEWFDIMQTNLTSVYHLSKAMLRSMMKKRFGRIINIGSVVGSTGNPGQTNYCAAKAGVVGFSKSLAKEVAARGVTVNVVAPGFIATDMTEVLTDEQKAGILSNVPAGRLGEAKDIAKAVAFLASDDAGYITGTTLHVNGGLYLS

SEQ ID NO: 2806 - protein, 312 aa, H. influenzae strain 86-028NP
MKKFAMVFPGQGSQTVGMLADLATEYPIVIETFKQASDALGYDLWYLVQQGPAEELNKTWQTQPALLAASVAIYRVWQEKFPQLKPEVMAGHSLGEYSALVCAGVLDFQDAIKLVELRGKLMQQAVPEGTGAMYAIIGLDNEAIINACKQAEEGEVVSAVNFNSPGQVVIAGAKAAVERAAALCKEAGAKRALPLAVSVPSHCALMKPAAEQLAVTLENIQINTPTISVLNNVDVKAETEGTEIRTALVRQLYSPVRWTETVEKMAQDGVLALVEVGPGKVLNGLTKRIVGDLQAISVNDVASFNAVEEFLA

SEQ ID NO: 2807 - protein, 316 aa, H. influenzae strain 86-028NP
MNSRILSTGSYLPSHIRTNADLEKMVDTSDEWIVTRSGIRERRIAAEDETVATMGFEAAKNAIEAAQINPQDIELIIVATTSHSHAYPSAACQVQGLLNIDDAISFDLAAACTGFVYALSVADQFIRAGKVKKALVIGSDLNSRKLDETDRSTVVLFGDGAGAVILEASEQEGIISTHLHASADKNNALVLAQPERGIEKSGYIEMQGNETFKLAVRELSNVVEETLLANNLDKKDLDWLVPHQANLRIITATAKKLEMDMSQVVVTLDKYANNSAATVPVALDEAIRDGRIQRGQLLLLEAFGGGWTWGSALVRF

SEQ ID NO: 2808 - protein, 56 aa, H. influenzae strain 86-028NP
MAVQQNKKSRSRRDMRRSHDALTTAAVSVDKASGETHLRHHVTADGYYRGRKVINK

SEQ ID NO: 2809 - protein, 174 aa, H. influenzae strain 86-028NP
MQKVKLPLTVDPVKDAQRRLDYVGYYSANQLERLAESVVNVLSDAQVTLSFYVDPQKLVVMKGKVQIDVDLECQRCNEPYKQTLECEFTYSPVANWDQADDLPEIYEPIEFNEFGEIDLIGTVEDELILALPLVPMHSSEHCEVSAQEQVFGELPEELAKKPNPFAVLANLKQK

SEQ ID NO: 2810 - protein, 290 aa, H. influenzae strain 86-028NP
MMTSNSYWQRLKVAFQYVMPQIYLTQIAGWFAKQKWGKITHFVIKAFAKKYNIDMSIAQKGQFSDYASFNEFFIRPLKENARPINQNPTALCLPADGRISECGHIDDNLLLQAKGHFFSLEDLLAEDKELVETFKNGEFVTTYLSPRDYHRVHMPCDATLRKMIYVPGDLFSVNPFLAQYVPNLFARNERVICVFDTEFGTMVQILVGATITASIGTTWAGVINPPRHNEVKTWTYEGESAVKLLKGQEMGWFQLGSTVINLFQANQVRLADHLSVNEPVRMGEILAYKK

SEQ ID NO: 2811 - protein, 456 aa, H. influenzae strain 86-028NP
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGTKEQVTADHILIATGGRPYRPNIKGQEYGIDSDGFFALTELPKRAVVIGAGYIAVELSGVLNSLGVETHLLVRRHAPMRNQDPLIVETLVEVLAQDGIQLHTNSTPSEIVKNADGSLTVKCDGQSDVTVDCVIWAAGRVPTTDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVMGLHGIGFGVDEMIQGFAVAIKMGATKADFDNTVAIHPTGSEEFVTMR

SEQ ID NO: 2812 - protein, 199 aa, H. influenzae strain 86-028NP
MALVNKIKTLSSVGILAATLFLAGCQAQSNILAFTPPVPSASMNVNRTAVVSVTTKDSRTIQEIASYTKHGELIKLNASPSVTQLFQQVMQQNLISKGFRIGQLNGSNAWVTVDVHEFGTQVEQGNLRYKLNTKIQATVYVQGAKGSYNKSFNVTRSQEGVFNADNDEIHKVLSQTFNDIVNNIYQDQEVAAAINQYSN

SEQ ID NO: 2813 - protein, 447 aa, H. influenzae strain 86-028NP
MITIKKGLDLPIAGKPAQVIHSGNAVNQVAILGEEYVGMRPSMKVREGDVVKKGQVLFEDKKNPGVIFTAPASGTITAINRGEKRVLQSVVINVEGDEKITFAKYSTEQLNTLSSEQVKQNLIESGLWTALRTRPFSKVPSIESEASSIFVNAMDTNPLAADPSVVLKEYSQDFTNGLTVLSRLFPSKPLHLCKAGDSNIPTADLENLQIHDFTGVHPAGLVGTHIHFIDPVGIQKTVWHINYQDVIAVGKLFTTGELYSERVISLAGPQVKEPRLVRTIIGANLSQLTQNELSAGKNRVISGSVLCGQIAKDSHDYLGRYALQVSVIAEGNEKEFFGWIMPQANKYSVTRTVLGHFSKKLFNFTTSENGGERAMVPIGSYERVMPLDILPTLLLRDLIVGDTDGAQELGCLELDEEDLALCSFVCPGKYEYGSILRQVLDKIEKEG

SEQ ID NO: 2814 - protein, 411 aa, H. influenzae strain 86-028NP
MGLKNLFEKMEPAFLPGGKYSKLYPIFESIYTLLYTPGTVTHKNTHVRDALDSKRMMITVFLALFPAIFYGMYNVGNQAIPALNQLGNLDQLIANDWHYALASSLGLDLTANATWGSKMALGAIFFLPIYLVVFTVCTIWELLFSVVRGHEVNEGMFVSTILFALIVPPTLPLWQAALGITFGIIVAKEIFGGVGRNFMNPALAGRAFLFFAYPAQISGDTVWTAADGFSGATALSQWSQGGQGALQHTVTGAPITWMDAFVGNLPGSMGEVSTLAILIGGAVIVFTRIAAWRIIAGVMIGMIATSTLFNLIGSETNPMFSMPWHWHFVLGGFALGMVFMATDPVSASFTNTGKWWYGALIGVMAVLIRTVNPAYPEGMMLAILFANLFAPIFDYIVVQANIKRRRARTNG

SEQ ID NO: 2815 - protein, 244 aa, H. influenzae strain 86-028NP
MAKFNKDSVGGTILVVLLLSLVCSIIVAGSAVMLKPAQEEQKLLDKQKNILNVAGLLQANTNVKETYAKFIEPRFVDLATGEYTQQADDSQQAIPADADKARIRSRSKTTEVYLVKDEQGQTQQVILPIYGTGLWSVMYGLVSVQPDGNTINGITYYQHGETPGLGGEIENPNWASLFKGKKLFDEQHQPAIRIVKGQAPQDEHSIDGLSGATLTGNGVQGTFNYWFSKDGFGPYLEKLHSGAN

SEQ ID NO: 2816 - protein, 208 aa, H. influenzae strain 86-028NP
MSGKTSYKDLLLAPIAKNNPIALQILGICSALAVTTKLETAFVMAIAVTLVTGLSNLFVSLIRNYIPNSIRIIVQLAIIASLVIVVDQILKAYAYGLSKQLSVFVGLIITNCIVMGRAEAFAMKSPPVESFVDGIGNGLGYGSMLIIVAFFRELIGSGKLFGMTIFETIQNGGWYQANGLFLLAPSAFFIIGFVIWGLRTWKPEQQEK

SEQ ID NO: 2817 - protein, 198 aa, H. influenzae strain 86-028NP
MEHYISLFVKAVFIENMALSFFLGMCTFLAVSKKVSTAFGLGIAVTFVLGIAVPVNQLIYANVLKENALIEGVDLSFLNFITFIGVIAGLVQILEMVLDKFMPSLYNALGIFLPLIAVNCAIFGGVSFMVQRDYNFPESIVYGFGSGLGWMLAIVALAGLTEKMKYADIPAGLKGLGITFISVGLMALGFMSFSGIQL

SEQ ID NO: 2818 - protein, 411 aa, H. influenzae strain 86-028NP
MSDSVILALGIAAFTVIVLVLVAIILFAKSKLVDSGDITIDINDDPEKAITLPAGGKLLGALASKGIFVSSACGGGGSCGQCIVKVKNGGGEILPTELSHINKREAKEGYRLACQVNVKGNMEVELPEEIFGVKKWECTVISNDNKATFIKELKLAIPEGEEVPFRAGGYIQIEAEPHVVNYKDFDIPEEYHEDWDKYDLWRYVSKVDEHIIRAYSMASYPEEKGIIMLNVRIATPPPRQPDAPPGQMSSYIWSLKAGDKVTISGPFGEFFAKETNAEMVFIGGGAGMAPMRSHIFDQLKRLHSKRKMSFWYGARSKREIFYQEDFDQLQAENPNFVWHVALSDALPEDNWTGYTGFIHNVLYENYLKNHEAPEDCEYYMCGPPVMNAAVIKMLKDLGVEDENILLDDFGG

SEQ ID NO: 2819 - protein, 346 aa, H. influenzae strain 86-028NP
MKKLISGIIAVAMALSLAACQKETKVISLSGKTMGTTYHVKYLDDGSIKATSEKTHEEIEAILKDVNAKMSTYKKDSELSRFNQNTQVNTPIEISADFAKVLAEAIRLNKVTEGALDVTVGPVVNLWGFGPEKRPEKQPTPEQLAERQAWVGIDKIALDMSGAKPTLSKALPQVYVDLSSIAKGFGVDQVAEKLEQLNAQNYMVEIGGEIRAKGKNIEGKPWQIAIEKPTTTGERAAEAVIGLNNMGMASSGDYRIYFEENGKRFAHEIDPKTGYPIQHHLASITVLAPTSMTADGLSTGLFVLGEDKALEVAEKNNLAVYLIIRTDNGFVTKSSSAFKKLTETKE

SEQ ID NO: 2820 - protein, 86 aa, H. influenzae strain 86-028NP
MQTLFFTLIAFVAIILLMSIGFIIKKQSLKGSCGGLSSLGIDKACDCDKPCDTLQSKLDAGDEQAKAEYEQKFAKKDDNSQFYEVK

SEQ ID NO: 2821 - protein, 397 aa, H. influenzae strain 86-028NP
MTNVLRLNRSYGRTMLISNTYNQHFPQLTQEQLARNATKKVICGMSGGVDSSVSAFILQQQGYQVEGLFMKNWEEDDDTDYCTAAADLADAQAVCDKLGIKLHKINFAAEYWDNVFEHFLTEYKAGRTPNPDILCNKEIKFKAFLEYAAEDLGADYIATGHYVRRAGDNENAKLLRGLDANKDQSYFLYTLSHKQVGQSLFPVGEIEKPIVRAIAEDLGLITAKKKDSTGICFIGERKFKDFLARYLPAQPGNIRTVDDEIIGRHDGLMYHTLGQRKGLGIGGLKNAGDEAWYVVDKDVENNELIVAQGHDHPRLFSKGLIASQLHWVDREPIRESLRCTVKTRYRQQDIPCVIEPIDDETIRVIFDEPQSAVTPGQSAVFYLGEVCLGGGIIAERI

SEQ ID NO: 2822 - protein, 244 aa, H. influenzae strain 86-028NP
MQAINPNWNVPKNIHAFTTTREGGVSLAPYLSFNLGDHVGDDKSAVKTNRTLLVEKFGLPQKPIFLTQTHSTRVLQLPYSGQNLEADAVYTNVPNQVCVVMTADCLPVLFTTTSGNEVAATHAGWRGLCDGVLEETVKYFQAKPEDIIAWFGPAIGPKAFQVGIDVVEKFVAVDEKAKLAFQPDAIEEGKYLSNLYQIATQRLNNLGITQIYGGNHCTFNEKEKFFSYRRDNQTGRMASVIWFE

SEQ ID NO: 2823 - protein, 324 aa, H. influenzae strain 86-028NP
MPQITLSAEVQPEQMGQRLDQTLAELFPEYSRSRLKTWIEADLVKLNDRITNIPREKVFGGERIEIIVEVEDETRFEAENIPLNIVYEDDDIIVINKPKDLVVHPGAGNPNGTVLNALLYHYPPISEVPRAGIVHRLDKDTTGLMVVAKTIPAQTKLVRDLQKRKITREYEAVASGIMTKGGTVDQPMARHATKRTLMAVHPMGKPAVTHYRIMENYRNYTRLRLRLETGRTHQIRVHMAHIAHPLLGDQTYGGRPRPPKNASEDFMEVLRNFKRQALHAVMLRLAHPITGEIMEWYAPLPDDFVELLNALKADYLKHQDELDY

SEQ ID NO: 2824 - protein, 262 aa, H. influenzae strain 86-028NP
MRKIKSLALLAVAALVIGCSSGSKDVEQASVNELYTKGTTSLQEGSYSEAIRYLKATTERFPGSVYQEQAMLDLIYANYKTQDYTQVLLMVDSFLHQFPQSPNQAYAVYMAGLTNAATGDNFIQDFFGIDRATRETTSMRTAFSNFQNLVRVFPNSPYAQDALARMAYIKDALARHELEIAKFYAKRKAWVAVANRVVGMLKQYPDTKATYEGLFLMQEAYEKMGLTALANDTQKIIDANKDKTFAPIEKPNEPDLKVPAVK

SEQ ID NO: 2825 - protein, 160 aa, H. influenzae strain 86-028NP
MKKIILTLSLGLLTACSAQIQKAKQNDVKLAPPTDVRSGYIRLVKNVNYYIDSESIWVDNQEPQIVHFDAVVNLDKGLYVYPEPKRYARSVRQYKILNCANYHLTQVRTDFYDEFWGQGLRAAPKKQKKHTLSLTPDTTLYNAAQIICANYGEAFSVDKK

SEQ ID NO: 2826 - protein, 246 aa, H. influenzae strain 86-028NP
MSVLGRIHSFESCGTVDGPGIRFILFMQGCLMRCKYCHNRDTWDLEGGKEISVEDLMKEVVTYRHFMNATGGGVTASGGEAVLQAEFVRDWFRACKAEGINTCLDTNGFVRHYNHIIDELLDVTDLVLLDLKELNDQVHQNLIGVPNKRTLEFAKYLQKRNQHTWIRYVVVPGYTDSDHDVHLLGQFIEGMTNIEKVELLPYHRLGAHKWKTLGLDYELEDVLPPTKESLEHIKTILEGYGHTVKF

SEQ ID NO: 2827 - protein, 772 aa, H. influenzae strain 86-028NP
MTMSELNEMQKLAWAGFAGGDWQENVNVRDFIQKNYTPYEGDDSFLAGPTEATTKLWESVMEGIKIENRTHAPLDFDEHTPSTIISHAPGYINKDLEKIVGLQTDEPLKRAIMPFGGIKMVEGSCKVYGRELDPKVKKIFTEYRKTHNQGVFDVYTPDILRCRKSGVLTGLPDAYGRGRIIGDYRRVALYGVDFLMKDKYAQFSSLQKDLEDGVNLEATIRLREEIAEQHRALGQLKQMAASYGYDISNPATNAQEAIQWMYFAYLAAIKSQNGAAMSFGRTATFIDVYIERDLKAGKITETEAQELVDHLVMKLRMVRFLRTPEYDQLFSGDPMWATETIAGMGLDGRTLVTKNTFRILHTLYNMGTSPEPNLTILWSEQLPENFKRFCAKVSIDTSSVQYENDDLMRPDFNNDDYAIACCVSPMIVGKQMQFFGARANLAKTLLYAINGGIDEKLGMQVGPKTAPITDEVLDFDTVMTRMDSFMDWLAKQYVTALNVIHYMHDKYSYEAALMALHDRDVYRTMACGIAGLSVAADSLSAIKYAKVKPVRGDIKDKDGNVVATNVAIDFEIEGEYPQYGNNDNRVDDIACDLVERFMKKIQKLKTYRNAVPTQSVLTITSNVVYGKKTGNTPDGRRAGAPFGPGANPMHGRDQKGAVASLTSVAKLPFAYAKDGISYTFSIVPNALGKDAEAQRRNLAGLMDGYFHHEATVEGGQHLNVNVLNREMLLDAMENPDKYPQLTIRVSGYAVRFNSLTKEQQQDVITRTFTESM

SEQ ID NO: 2828 - protein, 284 aa, H. influenzae strain 86-028NP
MASENQKLSSVALTPVEATDYAENTATYKANKRPFLSFMSGISAGACIALAFVFYTTTQTASAGAPWGLTKLVGGLVFSLGVIMVVILGSELFTSSTLTLVARVGGRITTTQMIRNWIVVYLGNFVGGLFIAAVIWFSGQTMAANGQWGLTILATAQHKIHHTWFEAFNLGILCNIMVCVAVWMSYSGKTVTDKAFIMIMPIGLFVASGFEHCVANMFMIPMGIITAHFSTPEFWQQIGVDPMKYADLDLYHFIVKNLIPVTLGNIVGGAICIGVFQRYLTKTH

SEQ ID NO: 2829 - protein, 304 aa, H. influenzae strain 86-028NP
MYYGLDIGGTKIELAVFNEELEKLYSERVPTPKTDYEEWLNTIVDLVNRADEKFGEVGTVGLGVPGFVNQQTGLAEITNIRVADNKPILRDLSVRLGREVRAENDANCFALSEAWDTENQQYPTVLGLILGTGFGGGFVLNGKVHSGQVGMAGELGHLQLNYHALKLLGWDNAPIYQCGCGNKACLDNYLSGRGFEMLYRDLKGETLSAREIIDLFYQGNESAVDFVNLFVELAAISIGNIITAFDPHMIVLGGGLSNFDYLYEALPKALPPHLMRTAKVPPIKKAKHGDSGGVRGAAALFLTK

SEQ ID NO: 2830 - protein, 481 aa, H. influenzae strain 86-028NP
MIMDFEFSKMLEEVLTWIVAHLDGPLWDVTIIILLGTGLFFTITTGFVQFRLFPASLREMWFGRAVEGSSLTPFQAFTTGLASRVGVGNIGGVATAIALGGEGAVFWMWVTAFIGMSSAFAESTLAQLFKIQDKDGSFRGGPAYYIVQGLKSRCMAVAFALALIFTFGFAFNSVQANSIVEATSNAWNWKGEYVGISLVIFTALIIFGGVKRIAIISSNLVPMMALFYLIIAVIILGMHIDMIPSVIHRIVQSAFSFDAAAGGMFGALVSKAMMMGIKRGLFSNEAGMGSAPNSAAAAHVKHPVSQGLVQMLGVFVDTMIVCTCTAVIILLSNNYGSETLKSISLTQNALQYHIGEFGVHFLAFILLLFAYSSIIGNYAYAESNIRFIKNKPWFVFLFRLMVLFFVYFGAVRSGNVVWNFADTVMAVMAIINLIAILMLSPIVWKLMKDYQRQLKEGKTPEFKIDEYPELRKKIFDSRIWK

SEQ ID NO: 2831 - protein, 275 aa, H. influenzae strain 86-028NP
MKLIEQHQIFGGSQQVWAHNAQMLQCEMKFAVYLPNNPENRPLGVIYWLSGLTCTEQNFITKSGFQRYAAEHQVIVVAPDTSPRGEQVPNDAAYDLGQGAGFYLNATEQPWATNYQMYDYILNELPDLIEANFPTNGKRSIMGHSMGGHGALVLALRNRERYQSVSAFSPILSPSQVPWGEKAFSTYLGEDREKWQQYDASSLIQQGYKVQGMRIEQGLEDEFLPTQLRTEDFIETCRVASQPVDVRFHKGYDHSYYFIASFIGEHIAYHAEFLK

SEQ ID NO: 2832 - protein, 135 aa, H. influenzae strain 86-028NP
VTYTTAKAAEKIGISAYTLRFYDKEGLLPNVGRDEYGNRRFTDKDLQWLSLLQCLKNTGMSLKDIKRFAECTIIGDDTIEERLSLFENQTKNVKCQIAELKRYLDLLEYKLAFYQKAKALGSVKAVNLPQIPETS

SEQ ID NO: 2833 - protein, 95 aa, H. influenzae strain 86-028NP
MAKKSIFRAKFFLFYRTEFIMFGLSPAQLIILLVVILLIFGTKKLRNAGSDLGAAVKGFKKAMKEDEKVKDAEFKSIDNETASAKKENIKEKEQA

SEQ ID NO: 2834 - protein, 186 aa, H. influenzae strain 86-028NP
VFDIGFSELILLMVLGLVVLGPKRLPIAIRTVMDWVKTIRGLAANVQNELKQELKLQELQDSIKKAESLNLQALSPELSKTVEELKAQADKMKAELEDKAAQAGTTVEDQIKEIKNAAENAEKPQNAISVEEAAETLSEAEKTPTDLTALETHEKVELNTHLSSYYPPDDIEIAPASKSQSSKTKS

SEQ ID NO: 2835 - protein, 256 aa, H. influenzae strain 86-028NP; identical to SEQ ID NO: 739

SEQ ID NO: 2836 - protein, 449 aa, H. influenzae strain 86-028NP
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALLEIKNVKRGRVKDYAELFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 2837 - protein, 146 aa, H. influenzae strain 86-028NP
MSEENIKLLKKVGLKITEPRLTILALMQNHKNEHFSAEDVYKILLEQGCEIGLATVYRVLNQFDEAHIVIRHNFEGNKSVFELAPTEHHDHIICEDCGKVFEFTDNIIEQRQREISEKYGIKLKTHNVYLYGKCSDINHCDENNSK

SEQ ID NO: 2838 - protein, 174 aa, H. influenzae strain 86-028NP
MAIVGLFYGSDTGNTENIAKQIQKQLGSDLIDIRDIAKSSKEDIEAYDFLLFGIPTWYYGEAQADWDDFFPTLEEIDFTDKLVGIFGCGDQEDYADYFCDAIGTVRDIIEPHGAIVVGNWPTEGYNFEASKALLEDGTFIGLCIDEDRQPELTAERVEKWCKQIYDEMCLAELA

SEQ ID NO: 2839 - protein, 201 aa, H. influenzae strain 86-028NP
MKIIEVDEELYQYIASQTRSIGESASDILRRLLSLPVHTSSVDDLVLTSAETNKSADQKPEQAINVKEVNIKTTKKQSITAINQIVEKVQTLLNSTEFQEESKAVVRFLAILRVLYRTNPESFAQATESLQGRTRVYFARDEATLLMAGNHTKPKQIPDTPYWVITNTNSGRKMLMLEGAMQSMELPETLIDEVRSYFTVN

SEQ ID NO: 2840 - protein, 287 aa, H. influenzae strain 86-028NP
MIFIFISLFAKIFFNYNDFFTNSHVKIMAKSLLNYQFHQVKQTINTPVLIFIHGLFGDMDNLGVIARAFSEHYSILRIDLRNHGHSFHSEKMNYQLMAEDVIAVIRHLNLSKVILIGHSMGGKTAMKITALCPELVEKLIVIDMSPMLYEGFGHKDVFNGLFAVKNAKPENRQQAKPILKQEINDEDVVQFMLKSFDVNSADCFRFNLTALFNNYANIMDWEKVRVFTPTLFIKGGNSSYIKIENSEKILEQFPNATAFTINGSGHWVHAEKPDFVIRAIKRFLNKN

SEQ ID NO: 2841 - protein, 452 aa, H. influenzae strain 86-028NP
MYPWQNFAIQPDFSDKIALRTTQSDALTWIELTTKINQTVAFLQKKGVNAESAVAFVGKNSEKILFLYLATIQLGAKVLGINPAFPQEKIAELCEFYQIDFCFYDKDLLNLQEIDAFTQKANFFRPATMTLTSGSTGLPKAVVHNVQAHLDNAKGVCNLMKFDCNQSWLLSLPLYHVSGQGIVWRWLYCGAQLHFPKDDFYASLLETTHVSLVPTQLQRLLDYLQENSIISFSTRHILLGGTHIPAELTKKIVKYGIETYSGYGMTEMASTVFAKKSDEKQGVGQPLLGREYRLVNDEVWLKGAGLAMGYWKDRQIVSLTNNQGWLPTKDKGVWQEGELVIIGRLDNMFISGGENIQPEEIEQVIIQHSSVNQVFVLPQKNKEFGQRPVALVDFNESFSKSAVENLMFFLQDKLARFKQPIAYYPLPLMLGKGIKISRKQLADWLAKQDKIN

SEQ ID NO: 2842 - protein, 1112 aa, H. influenzae strain 86-028NP
MIRKLMKTPPFFTVLFASAMFTLSVSQGALGANSTNVLPTEQSLKADLANAQKMSEGEAKNTLLAELQTSIDLLQQIQAQQKINDALQTTLSHSESEIRKNNAEIQALKKQQETATSTDYNAQSQDDLQNSLAKLNDQLQDTQNALGAANAQLAGQNSISERAQAALTENVVRTQQINQQLANNDIGSALRKQYQIELQLIDLKNSYNQNLLKNNDQLSLLYQSRYDLLNLRLQVQQQNIIAIQEVINQKNLQQSQNQLEQAQQQQQKTVQNDYIQKELDRNAQLGQYLLQQTEKANSLTQDELRMRNILDSLTQTQHTIDEQISALQGTLVLSRIIQQQKQKLPTNLNIQGLSKQIADLRVHIFDITQKRNELYDLNNYINKVESEDGKQFTEAERTQVKTLLTERRKMTSDLIKSLNNQLNLAISLELTQQQITQISDQIQSKLEQQSFWVKSNNPINLDWIKMLPRALIEQFNGMLKKLGFPTNYDNLPYLLMYFLGLFIVGGAIFKFKNRIKQQLNKINREIHRLDTDSQWSTPLALLLTAFLTLSSTLWFLAVCQMIGFFFFKNPEEFWHWSFSMAGYWWFFTFWISLFRPNGIFVNHFESSKENAQRFRGVIQRIIIVIVLLLNTSVFSNVTDAGLANDVLGQINTITALIFCAAIIAPRFNRVLRSYEPETNKHHWLIRIVQIGLRLIPVGLIVLIVLGYYYTALNLIEHFIHSYIAWCVWWLVRNTIYRGITVSSRRLAHRRLAEKRRQKALENNYENISSDDVVAVGEPEEGLALNDVRSQLLRFVDLFIWTALLGIFYYVWSDLVTVVSYLREITLWQQTTTTDAGTVIESITLFNLLVALVILGITYVLVRNISGILEVLIFSRVNLSQGTPYTITTLLTYIFIAIGGAWAFATLGMSWSKLQWLFAALSVGLGFGMQEIFANFVSGIILLFERPIRVGDVVTINGVSGTVAKIRIRAITLIDFDRKEIIVPNKSFVTGQVTNWALSSTMTRLVISVGVAYGSDLTLVRQLLLQAADEQPTVLRDPKPSAYFLTFGASTLDHELRVYVEQVGDRTSTTDAINRRINELFAEHNIDIAFNQLDVFIKNNDTGEEIPFVDVKK

SEQ ID NO: 2843 - protein, 357 aa, H. influenzae strain 86-028NP
MAGNTIGQLFRVTTFGESHGIALGCIVDGVPPNLELSEQDIQPDLDRRKPGTSRYTTPRREDDEVQILSGVFEGKTTGTSIGMIIKNADQRSQDYGEIKDRFRPGHADFTYQQKYGIRDYRGGGRSSARETAMRVAAGAIAKKYLREHFGIEVRGFLSQIGHVKISPQIIGEIDWEKVNSNPFFCPDESAVEKFDELIRELKKEGDSIGAKLTVIAENVPVGLGEPVFDRLDADLAHALMGINAVKGVEIGDGFAVVEQRGSEHRDEMTPNGFESNHAGGILGGISSGQPIIATIALKPTSSITISGRSINLNGEPVEVVTKGRHDPCVGIRAVPIAEAMMAIVLLDHLLRFKAQCK

SEQ ID NO: 2844 - protein, 286 aa, H. influenzae strain 86-028NP
MNKILLKTTIIFTALFSLNVVASPLDWQKVKRPIPSDDGKAKPIGSYTNGCIIGAQALPPKGDGYQVIRMNRNRYYGHPNMIQYIERLGQRAKAAGLPTMLVGDIAMPGGGRFLTGHASHQMGLDADIWLRMGEMSDADALNSDGKGLLVVDRKAQRVDERVWNSNHATLIKLAAQDPNVTRIFVNPAIKVKLCQTAGNDRGWLHKVRPWYGHNSHFHVRLTCPADASYCENQAPVPAGDGCGDELYSWFEPPKPGASVSKPKVTPPEPFLCQQILNSPNRSEWLE

SEQ ID NO: 2845 - protein, 255 aa, H. influenzae strain 86-028NP
MDIGIDLLAILFCVGFVASFIDAIAGGGGLITIPALLMTGMPPAMALGTNKLQAMGGALSASLYFLRKRAVNLRDIWFILIWVFLGSALGTLLIQSIDVAIFKKMLPFLILAIGLYFLFTPKLGDEDRKQRLSYMLFGLLVSPFLGFYDGFFGPGTGSIMSLACVTLLGFNLPKATAHAKVMNFTSNLASFALFLLGGQILWKVGFVMMAGSILGANLGAKMVMTKGKTLIRPMVVIMSFMMTAKMIYDQGWFHF

SEQ ID NO: 2846 - protein, 318 aa, H. influenzae strain 86-028NP
MSDNQQNLRLTARVGYEAHFSWSYLKPQYWGIWLGIFFLLLLAFVPFRLRDKFAGKLGIWIGHKAKKQRTRAQTNLQYCFPHWTEQQREQVIDKMFTVVTQVMFGIGEIAIRSKKHLQKRSEFIGLEHIEQAKAEGKNIILMVPHGWAIDASGIILHTQGMPMTSMYNPHRNPLVNWLWTIARQRFGGKMHARQNGIKPFLNHVRKGEMGYYLPDEDFGVEQSVFVDFFGTYKATLPGLNKMAKLSKAVVIPMFPRYNAETGKYEMEIHPAMNLSDDPEQSARAMNEEIESFVTPSPEQYVWILQLLRTRKDGEDLYD

SEQ ID NO: 2847 - protein, 323 aa, H. influenzae strain 86-028NP
VLGTILHSELEKFYDPNLLVGNETADDAAVYDLGNGTAIISTTDFFMPIVDDPFDFGRIAATNAISDIFAMGGKPIMGIAILGFPTNVLPAEVAQKIVDGGRFACHQAGIALAGGHSIDSPEPIFGLAVTGVIDTEKVKRNASAKSGCKLYMTKPLGIGILTTAEKKGKLKPEHQGLATAAMCQMNSIGSQFSQVDGVTAMTDVTGFGLLGHLIEICEGSNLSAVVFSDKIKTLDGVKDYIAQGCVPGGTGRNFESYGHKVGALTEEQKAILCDPQTSGGLLVAVEPNSVQTIIEIAKDTGIDLYEVGKLKPKSESDIVVEVK

SEQ ID NO: 2848 - protein, 116 aa, H. influenzae strain 86-028NP
MSNIIKQLEQEQLKQNVPSFRPGDTLEVKVWVVEGSKRRLQAFEGVVIAIRNRGLHSAFTLRKVSNGVGVERVFQTHSPAVDSIAVKRKGAVRKAKLYYLRERSGKSARIKERLGA

SEQ ID NO: 2849 - protein, 246 aa, H. influenzae strain 86-028NP
MWIGVISLFPEMFKAITEFGVTGRAVKHNLLKVECWNPRNFTFDKHKTVDDRPYGGGPGMLMMVQPLRDAIHTAKAAAGEGAKVIYLSPQGRKLDQDGVTELAQNQKLILVCGRYEGIDERLIQTEIDEEWSIGDYVLTGGELPAMTLIDAVARFIPGVLGKQASAEEDSFADGLLDCPHYTRPEVLEGLTVPPVLMSGHHEEIRKWRLKQSLQRTWFRRPELLEGLALTDEQRKLLKEAQAEHNS

SEQ ID NO: 2850 - protein, 175 aa, H. influenzae strain 86-028NP
MEQQHIEVVGKLGSTYGIRGWLRIYSSTEQAESIFDYQPWFLKIKGEWQSIELENWRYHNHEIIVKLKGVDDRETAQILANVEIGVDLSVFPELEEGDYYWHDLIGCTVVNLEGYTMGTVTEMMETGSNDVLVVKANTKDAFGKQERLIPFLYEQVVKRVDLTTKTIEVDWDAGF

SEQ ID NO: 2851 - protein, 82 aa, H. influenzae strain 86-028NP
MVTIRLSRGGAKKRPFYQIVVADSRSPRDGRFIERVGFFNPIAQGNAERLRINLERVNHWVAQGASLSDRVASLVKEAQKAA

SEQ ID NO: 2852 - protein, 261 aa, H. influenzae strain 86-028NP
MRFIMKISFHSVLIGLASFIGVQQGVIASPSSHQSISTESAEALKQQFSMALAKQDKQQITNLQKKLTALFSLPPQFLDNQIQISEKILTRIFKTDKNLTPKFLDYLYFEPINTVDANLIQEMKKNLLVSFLANDQAKIYIRQTDNSEQFVQTLMERGAKADQIILLSLNAKGIFQKIIEQIRQDFPNQTIFSITENRISLITPSSEIKSRLALANMMFNRQFKGVEVDDFSYLDQPRENLQHNNDAIRYKTFQAMLEGLN

SEQ ID NO: 2853 - protein, 603 aa, H. influenzae strain 86-028NP
MLLSKKSATFALSAFAMLFTSVALAKEAPQAHKAVELSILHINDHHSYLEPHETRINLNGQQTKVDIGGFSAVNAKLNKLRKKYKNPLVLHAGDAITGTLYFTLFGGSADAAVMNAGNFHYFTLGNHEFDAGNEGLLKLLEPLKIPVLSANVIPDKSSILYNKWKPYDIFTVDGEKIAIIGLDTVNKTVNSSSPGKDVKFYDEIATAQIMANALKQQGINKIILLSHAGSEKNIEIAQKVNDIDVIVTGDSHYLYGNDELRSLKLPVIYEYPLEFKNPNGEPVFVMEGWAYSAVVGDLGVKFSPEGIASITRKIPHVLMSSHKLQVKNSEGKWAELTGDERKKALDTLKSMKSISLDDHDAKTDKLIAKYKSEKDRLAQEIVGVITGSAMPGGSANRIPNKAGSNPEGSIATRFIAETMYNELKTVDLTIQNAGGVRADILPGNVTFNDAYTFLPFGNTLYTYKMEGSLVKQVLEDAMQFALVDGSTGAFPYGAGIRYEANETPNAEGKRLVSVEVLNKQTQQWEPIDDNKRYLVGTNAYVAGGKDGYKTFGKLFNDPKYEGVDTYLPDAESFIKFMKKHPHFEAYTSSNVKFNASTDALPKK

SEQ ID NO: 2854 - protein, 180 aa, H. influenzae strain 86-028NP
MAEKRNIFLVGPMGAGKSTIGRQLAQQLNMDFIDSDAVIEERTGADISWIFDLEGEDGFRKREERIINELTQMQGIVLSTGGGAVLSKENRNYLSARGIVIYLETTVEKQFQRTQRDKKRPLLQDAENPRQVLEDLAKIRNPLYEEIADITLPTDEQNAKVMVNQIVDLIDNMNGLNGAL

SEQ ID NO: 2855 - protein, 362 aa, H. influenzae strain 86-028NP
MLCVNVELQERRYPILIGSGLLQDERSYPIKRGDRVMIVTNPTVAQFYLDTVIYALEKRGCVVDHVLLPDGEKYKTLESLNLIFTALLQDNHGRDTTIIALGGGVIGDVAGFVAASYQRGVRLIQMPTTLLSQVDSSVGGKTAVNHELGKNMIGAFYQPSMVIIDTLTLNTLPKREVNAGLAEVIKYGAILDYEFFEWLEQHIDELVALHPEALQHCISRCCQIKADVVARDETEKGDRALLNLGHTFGHAIETHLGYGNWLHGEAVSTGMMMAAVLSEELGDISIADVSRLEKLLARANLPTVSPDTMQPEDYLPHMMRDKKVLSGKLRLVLLKSLGQAYVANDTDHTLVLNAIRRCTQTD

SEQ ID NO: 2856 - protein, 286 aa, H. influenzae strain 86-028NP
MLRPKKQSLKPKLKHRPFLKWAGGKFRLTDEINKAFPNKKNCLIEPFVGAGAIFLNSNFERYILADINPDLINLFNIVKENVEGYIEDCKPIFFADDANTPDYYYAKRRQFNASTDPFERSIIFLYLNRFGFNGLCRYNSKNEFNVPFGAYKTHYFPEDELRYFAHKAQSAVFLCCDFQKTFEFADKDSVIYCDPPYAPLQQETNFTGYAGNEFGLVQQRALADLAKSIQKEKQISILISNHDTKFTREIYNGAKFKRVKVQRSISQNPEKRVKVKELIAIFGARK

SEQ ID NO: 2857 - protein, 35 aa, H. influenzae strain 86-028NP
MNYFIMDKTFLEQEILLPQFIIQNIERWFKTHNFV

SEQ ID NO: 2858 - protein, 241 aa, H. influenzae strain 86-028NP
MFKRLSLYTLLLCLVPFFIWGISYQWHGNSQLTQADYWLYLLTETGSVPYALITCVLFTLLFAFLFKNPKQWLLGVIVMGISVIATQAAKTGAKALFEEPRPFTVYLAEQTHSTPENFYKNDRTLRAEIAKNFYSMDAITPAWLVHHYENETGYSFPSGHTIFAATWLMLAVGFTQLLGNRSFKAKLLVVGIAVWGLLMLISRVRLGMHYPIDLLVATLLAWLINGIIFAFLKKKAIFVMK

SEQ ID NO: 2859 - protein, 224 aa, H. influenzae strain 86-028NP
MTTNKDHFMAKIQLVAQANLPTEYGIFKMVGFEFPDTKKEHVALVMGDISNADEPVLARIHSECLTGDALHSLKCDCGFQLATALKQIQEEGRGVLIYHREEGRGIGLINKIRAYSLQDKGMDTIEANLALGFKADERNFEVCADMFELLGVKKVRLMTNNPEKVETMKKAGINVVERVPLNVGENRYNTKYLDTKAKKMGHYIVHNNDEQHLMTCPHCQEEII

SEQ ID NO: 2860 - protein, 514 aa, H. influenzae strain 86-028NP
MNNLFALCQRSAVIFSIIFTVVACDKLDSPKPISPQIETQKNTQLESNRVELKRGVYSDLTLQPWQAQSEEQTQLLRDLFEGLTAYDVQSNLVPAVAENWQTEDNKTWIFTLRENAKWSNGEPITASDFVQSWQTLSQSESPLKNYLAFMNLKNAKAVLEKALPVESLGLFAENDRTLRIELDKASPYLPSMLAHVSLLPHYAKSTEIFISNGAYQLQSQAENQHILTTNPYYWAKEKVIFQQVKYQKIAADADLSDFDVVMNPKKVDQNIQDYPQLCTYFYEFNLSDPVLQKSAVRKAIVSMISTNNLVADIAHLYPNNTFLPKSMLGEQESVWEPVVAEQLFSQNQISETRPLKLRIRYDDSSLNQTIAMRLNHQLSQSDLLRVENQGMSWQELQTARTKGDFQLIRSGWCADFNDPAAFLNLFYSKSPDNKNGYKNAEFDRLFESAMTTTSGKVRLENYAKLKGIVQQEHLVLPIFQYSTPVYLAPSIMGAQVNSVGVIYSKDLWRKVQSQ

SEQ ID NO: 2861 - protein, 120 aa, H. influenzae strain 86-028NP
MKIIYIILGFLSLAIGIIGIFLPLLPTTPFLLLTLFFFTKGSKRLEQWFLGTSIYQKHLKSFHENRSLKKNTKIFILTFATTMLLIGFYFTPSVIGRSVIVALICIKFWFFLFWIKTENE

SEQ ID NO: 2862 - protein, 681 aa, H. influenzae strain 86-028NP
MSMSNPLLHIQGLPPFSQIKPEHIQPAVEKLIQDCRNTIEQVLKQPHFTWENFILPLTETNDRLNRAWSPVSHLNSVKNSTELREAYQTCLPLLSEYSTWIGQHKGLYNAYLALKNSAEFADYSIAQKKAIENSLRDFELSGIGLSEEKQQRYGEIVARLSELNSQFSNNVLDATMGWEKLIENEAELAGLPESALQAAQQSAESKGLKGYRFTLEIPSYLPVMTYCENRALREEMYRAYATRASEQGPNAGKWDNSKVMEEILTLRVELAKLLGFNTYTELSLATKMAENPQQVLDFLDHLAERAKPQGEKELQELKNYCEKEFGVTELAPWDIGFYSEKQKQHLYAINDEELRPYFLENRVISGLFKLIKRIFNIRAVERKGVDTWHKDVRFFDLIDENDQLRGSFYLDLYAREHKRGGAWMDDCIGRKRKLDGSIETPVAYLTCNFNAPIGNKPALFTHNEVTTLFHEFGHGIHHMLTQIDVSDVAGINGVPWDAVELPSQFMENWCWEEEALAFISGHYETGEPLPKEKLTQLLKAKNFQAAMFILRQLEFGIFDFRLHHTFDAEKTNQILDTLKSVKSQVAVIKGVDWARTPHSFSHIFAGGYAAGYYSYLWAEVLSADAYSRFEEEGIFNPITGKSFLDEILTRGGSEEPMELFKRFRGREPQLDALLRHKGIMN

SEQ ID NO: 2863 - protein, 514 aa, H. influenzae strain 86-028NP
MAAAIQQRAELQRRIWQIANDVRGSVDGWDFKQYVLGTLFYRFISENFANYIEAGDESVNYAQLPDEIITPDIKTDAIKTKGYFIYPSQLFKNVAANAGNNPNLNTDLKQIFTDIENSATGFPSEQDIKGLFADFDTTSNRLGNTVKDKNDRLTAVLKGVAELDFGKFEDNHIDLFGDAYEYLISNYAANAGKSGGEFFTPQSVSKLIAQIAMHGQTSVNKIYDPAAGSGSLLLQAKKQFDEHIIEEGFFGQEINHTTYNLARMNMFLHNINYDKFDIALGNTLMEPQFGDDKPFDAIVSNPPYSVKWAGSDNPTLINDERFAPAGVLAPKSKADFAFILHALSYLSGKGRAAIVSFPGIFYRGGAEQKIRQYLVDNNFVETVIALAPNLFYGTSIAVNILVLSKHKPNTQTQFIDASGLFKSATNNNILEEEHIEQILKLFANKEDVPHLAKSVSFEEIAQNDHNLAVSSYVEQKDTREVINIDELNAQIRETVTNIDRLRAEIDKIVAEIEG

SEQ ID NO: 2864 - protein, 390 aa, H. influenzae strain 86-028NP
MKNNRTFLEKLLDGSEVEWKPLDEVANIVNNARKPVKSSSRVSGNIPYYGANNIQDYVEGYTHEGEFVLIAEDGSASLENYSIQWAVGKFWANNHVHVVNGKEKLNNRFLYHYLTNMNFIPFLAGKERAKLTKAKLQQIPIPIPPLSVQTEIVKILDALTALTSELTSELILRQKQYEYYREKLLSEEELGKVGFEWKTIDEISKKISSGGTPTTSNNGYYDNGTIPWLRTQEVDFKEIWDTNIKITEDALNNSSAKWIPANCVIVAMYGATVGKTAINKIPLTTNQACANIEINDKLACYRYIFHYLTSKYEYIKSLGSGSQTNINAQIIKKLKVPVPPIEEQYRIVSILDKFETLTNSITEGLPLAIEQSQKRYEYYRELLLNFPSRE

SEQ ID NO: 2865 - protein, 384 aa, H. influenzae strain 86-028NP
MTKSLDKIAKQLRDSDKKVNLIYAFNGSGKTRLSKVFKNLIAPKENHDNEEDLTRRKILYFNAFTEDLFYWDNDLLNDTEPKLKIQPNSFIRWLIRDQGDEGKVIGKFHHYCDEKLMPKFDIENNQITFSFARGDDTPEENIKLSKGEESNFIWSIFHTLIEQVVAELNISEPSERTTNEFDELKYIFIDDPVSSLDENHLIQLAVDLAELVKDSPDTIKFIITTHNPLFYNVLYNELGAKNGYILRKDENKNENERFDLEVKQGGSNKSFSYHLFLKNLLEEVKSKDIQKYHFMLLRNLYEKTANFLGYSGWSNLLPNDDARQSYYTRIINFTSHSTLSNEIIAEPTDAEKKIVKYLLEHLINNYGFYIEENIKEPQTDNITE

SEQ ID NO: 2866 - protein, 332 aa, H. influenzae strain 86-028NP
MNDLIIYNTDDGKSHVALLVVENEAWLTQNQLAELFDTSVPNITTHIKNILQDKELDEFSVIKDYLITAQDSKQYQVKHYSLDMILAIGFRVRSPRGVQFRRWANTQLRTYLDKGFLLDKERLKNPQGRFDHFDELLEQIREIRASELRFYQKVRELFKLSSDYDKTDKVTQMFFAETQNKLIYAITQQTAAELICTRANAKLPNMGLTSWKGAVVRKGDIITAKNYLTHDELDSLNRLVMIFLESAELRVKNRQDLTLNFWRNNVDNLIEFNGFPLLIGNGTRTVKQMETFTKEQYALFDQVRKQQKRIQADNEDLEILENWQKDLKKQKH

SEQ ID NO: 2867 - protein, 1027 aa, H. influenzae strain 86-028NP
MTQYKTIAESNNFIVLDQYNKFVEEPNAGYQTEGSLEREFIRDLQAQGYEYLQGLNNHDELIKNLRVQLQRLNNVIFSDAEWQRFLEEYLDKPSDNLIEKTRKIHDDYIYDFVFDNGRIQNIYLLDKKNLANNSLQVINQFEQTGSYDNRYDVTILVNGLPLVHIELKKRGVAIREAFNQIHRYSKESFNKENSLFKYIQIFVISNGTDTRYFANTTKRNKNSYDFTMNWATAKNTLIKDLKDFTATFLQKNTLLNVLVNYCVFDVSDTLLIMRPYQIAATERILWKIKSSYHAKNWSNKESGGYIWHTTGSGKTLTSFKASRLATELDFIDKVFFVVDRKDLDYQTMKEYQRFSPDSVNGSESTAGLKRNIEKDDNKIIVTTIQKLNNLMKSEENLSIYQKQVVFIFDEAHRSQFGEAQKNLKRKFKKFYQFGFTGTPIFPENALGAETTTSVFGTELHSYVITDAIRDDKVLKFKVDYNDVRPQFKALETEKDPEKLTALEQKQAFLHPERIKEISQYLLNNFKQKTHRLNATGKGFNAMFAVSSVEAAKRYYETLQNLQAEQEHPLKIATIFSFAANEEQDAIGDIPDETFEPTALNSTAKEFLTKAIDDYNHYFGTNYGVDSQSFQNYYRDLAKRVKNQEVDLLIVVGMFLTGFDAPTLNTLFVDKNLRYHGLMQAFSRTNRIYDTTKTFGNIVTFRDLEQNTIDAITLFGDDNTKNMVLEKSYETYFNGDENQRGYLEVVQELQNRFPNPTEIETEQDKKEFVKLFGEYLRVENILQNYDEFAALQALQAVDLNDPIAMEKFKQVHYVNDEQIAEMLKVPTLPVRAEQDYRSTYNDIRDWLRQRKEGNDKDNSPINWDDVVFEVDLLKSQEINLDYILALIFEHHKKNQDKEVLIDEIRRTVRSSLGNRAKESLIVDFINQTNLDDIPDKATLIDSFFLFAQAEQRKEAESLIQEENLNVDAAKRYISTSLKREYASENGTALNEVLPKMSPLTPQYLTKKQTIFQKIAAFVEKFKGVGGKI

SEQ ID NO: 2868 - protein, 209 aa, H. influenzae strain 86-028NP
MSVFNTFVEFVARIVAPMQRQFINFIRIAIFIVMAWIGGLKVCQYEADGIAHFVSNSPFFSYMYEKGPNLVPNDKGELVMEYTLHKNPEGKMVAKNIEWHKENGTYTASYIIGAIIVTVGILTLAGIWNATAGLAGGLLTFGMSIVTLSFLITTPEAWVPNLGGDLPTPAYGFPYLSGVGRLVIKDIIMMAGGLTAAAECANRILARKK

SEQ ID NO: 2869 - protein, 613 aa, H. influenzae strain 86-028NP
MHRFFYNDNNVLGDLMKNFKYFAQSYVDWVIRLGRLRFSLLGVMILAVLALCTQILFSLFIVHQISWVDIFRSVTFGLLTAPFVIYFFTLLVEKLEHSRLDLSSSVNRLENEVAERIAAQKKLSQALEKLEKNSRDKSTLLATISHEFRTPLNGIVGLSQILLDDELDDLQRNYLKTINISAVSLGYIFSDIIDLEKIDASRIELNRQPTDFPALLNDIYNFASFLAKEKNLIFSLELEPNLPNWLNLDRVRLSQILWNLISNAVKFTDQGNIILKIMRNQDCYHFIVKDTGMGISPEEQKHIFEMYYQVKESRQQSAGSGIGLAISKNLAQLMEGDLTVESERGKGATFHLTLHAQEISEKESVKKNIPSLNILLVEDVDLNIMVAKTILEKLGHHVDVATNGKQAITLFEKNVYDILLLDIKLPDMSGFEIAQYLRENYENGIYDFLPPMIAFTANVMQSEQEYLEMGMDGVLRKPISIKDLHHCLQQFFADESESIIEMNDDNELSEQFDLALIETLGKKQILENLSLFKQTMPNYLAQLSKDNMKETEDTAHKIKGAAASVGLNHLRQLADTLESAAKNSDVFNCGELIDEIGNLWLEDVEDLLKFCKF

SEQ ID NO: 2870 - protein, 214 aa, H. influenzae strain 86-028NP
LIFHIFQIDFIYSFLISFIMLKNLDEITSSIIADPQNKDFTERGIFPLFSAPKTARINIVGQAPGLKAEQSRLYWNDKSGDRLREWLGVDYDYFYNSGIFAVLPMDFYYPGKGKSGDLPPRQGFAERWHPMILGNLPNIQLTILIGQYAQKYYLPENKDNVTNTVKNYRQFLPHFMPLVHPSPRNQLWATKNPWFEEQVIPELQILVKQIINKD

SEQ ID NO: 2871 - protein, 302 aa, H. influenzae strain 86-028NP
MMNFTLLTYLADCQTKVRSELEKFSKNLEEDIQQLREIGLDILVDGQDYRLVPMLPLLNPQQISTALFPYGIHYQPIISSTNEWILQNIPSLKKGDLCVAEYQTAGRGRRGRQWLSPFAGQIMFSFYWTFDPKKSIEGLSLVIGLAIAEVLNVQVKWPNDILFDERKLGGILVEIANHKNGMLNLVIGVGINASLSKQTEISQPYAEVCEIDPDVDRQTLLPKLIQHLYTRLNIFEQNGIDEEFQQAWQSYNAFSNSEVKVLTEQGVISGIEQGIDERGHLKVLCGNKIQIFNGGEVSLRKK

SEQ ID NO: 2872 - protein, 488 aa, H. influenzae strain 86-028NP
MSLRIKQEALTFDDVLLVPAHSTVLPNTANLSTQLTKEIRLNIPMLSAAMDTVTETKLAISLAQEGGIGFIHKNMTIERQADRVRKVKKFESGIVSEPVTVLPNLTLAELAEMVKKNGFAGYPVVDEENNLIGIITGRDTRFVKDLSKTVSQVMTKKEDLVTVKEGASREEILELMHQHRVEKVLVVNDSFKLKGMITVKDFQKAEQKPNACKDEFGRLRVGAAVGAGPGNEERIDALVKAGVDVLLIDSSHGHSEGVLQRVRETRAKYPNLPIVAGNVATAEGAIALADAGASAVKVGIGPGSICTTRIVTGVGVPQITAIADAAAALKDRGIPVIADGGIRFSGDIAKAIAAGASCVMVGSMFAGTEEAPGEIELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 2873 - protein, 523 aa, H. influenzae strain 86-028NP
MTNIHNHKILILDFGSQYTQLIARRVREIGVYCELWAWDVTEQQIREFAPTGIILSGSPESTTEENSPRAPEYVFNASVPVLGICYGMQTMAMQLGGLTETSDHREFGYASVSLENSTALFANLNDNSTASEPKLDVWMSHGDKVTRLPENFKVTGTTPTCPIAAMSDENRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVKSVGVMGDGRKYDWVISLRAVETIDFMTAHWAHLPYDLLGKVSNRIINEVNGISRVVYDISGKPPATIEWE

SEQ ID NO: 2874 - protein, 300 aa, H. influenzae strain 86-028NP
MRFKMKVVTQGVLLCIFSQCLFGILYLFSIWLQPLSGTDVFAWRMLTMIFGLLLILFPTIGCRSLLSLITTTLGKSWTRWVLFLLGTLDAGSQFWLFMWAPLNGEGINIAMGYFLFPLIMAVLGWAWLKERLSFIQKIALLLAACGVAHELWHTQSFSWTSLWVCTVYPFYYLSRKLMKIPALQGITLDIILISIPCFIYILSQSDTLSLVTQEYRYWLLLPALGIVSAISLSANLKSSQQIPVSIFAVLSYIEPILLFLIAVFVLDNQITTSDYFTYVPIWLSLIVIGIEGLLNKNKVR

SEQ ID NO: 2875 - protein, 168 aa, H. influenzae strain 86-028NP
VIIFFSIVTFLRNYLMQTLDKLDRHILNVLQQDAMIPLKELSEKVNSSVATCQRRVQSLTDSGVITKRVAVVSPKAVGRTISVFVMVEMDNQHSYYQEQFERKMRQEDEVVSCYEISGDYDFMLLLHAKDMESYHAFTRRVLTGEFHVRTYKSLFVMNFTKADSGIIL

SEQ ID NO: 2876 - protein, 400 aa, H. influenzae strain 86-028NP
VNFLLCIFKGVYVIKLIQRFFKLESAGGILLLFSAVVAMLLANSPLSNQYNDFLNLPVSLQIGSFSINKTLIHWINDGFMAVFFVLVGMEVKKELFEGALSTYQQAIFPAIAAIGGMVIPAVVYWFIAKQDPSLANGWAIPMATDIAFALGIMALLSKQVPLPLKIFLLALAIIDDLGAIVVIALFFSHGLSVQALIFSAVAIIVLILLNRFKVSALCAYMVVGAILWASVLKSGVHATLAGVIIGFSIPLKGKKGERPLDDFEHILSSWSSFVILPLFAFANAGVSFAGIDVNMISSPLLLAIASGLIIGKPVGIFGFSYLSVKLGLAKLPDGINFKQIFAVAVLCGIGFTMSMFLASLAFDANAGESVNTLSRLGILLGSTVSAILGYLFLKQTTKLS

SEQ ID NO: 2877 - protein, 436 aa, H. influenzae strain 86-028NP
MFSRKDIIILGMMIFALFLGAGNIIFPPMEGFSSGQHWTSASLGFVLTGVLMPFITLVVVAILGRGEELTKDLPKWAGTGFLVILYLTIGSTFAMPRITNVAYEMAWLPLGLTENNANVRFVFSLIFNLIAMGFMISPNTIISSVGKFMTPALLVLLIAVAITVFISPLSEIQAPSNAYENSHSLLIGLTSGYQTMDVLAAIAFGGIVARALSAKNVTKTKDIVKYTISAGFVSVILLASLYFSLFYLGATSAAVAEGATNGGQIFSRYVNVLFGSAGTWIMAGIIVLASLTTLVGVTSASADYFSKFSVRFSYPFWAALFTAMTITVSQYGLTDLLRITIPALLLIYPVAIVLVLLQFLRKKLPSIKFTYNSTLLVTVCFSLCDSLNNVKMLPESINSLLKHFPLSSEGMAWLVPTLVMLVASIFIGKALHKTHS

SEQ ID NO: 2878 - protein, 155 aa, H. influenzae strain 86-028NP
MIISSLTNPNFKVGLPKVIAEVCDYLNTLDLNALENGRHDINDQIYMNVMEPETAEPSSKKAELHHEYLDVQVLIRGTENIEVGATYPNLSKYEDYNEADDYQLCADIDDKFTVTMKPKMFAVFYPYEPHKPCCVVNGKTEKIKKLVVKVPVKLI

SEQ ID NO: 2879 - protein, 148 aa, H. influenzae strain 86-028NP
MKYNVMMASDANYLPYVEITLKSLLMHNENLSVFILHTGDISESWQNDLQLYFAKRYSTLQLVHMISINTLDISLVIFHFTGPHKPLDNIFSENACVNAVISLFRLYASISWQIFALFHSVLQELIGLIKRDDVIGGFISFNRLGIIV

SEQ ID NO: 2880 - protein, 709 aa, H. influenzae strain 86-028NP
VNPIVKQFKYGQHTVTLETGAIARQATAAVMASMDDTTVFVTVVAKKDVKEGQDFFPLTVNYQERTYAAGKIPGGFFKREGRPSEGETLIARLIDRPIRPLFPEGFFNEIQVVATVVSVNPQISPDLVAMIGASAALTLSGVPFNGPIGAARVGFIDNQFVLNPTMAEQKQSRLDLVVAGTDKAVLMVESEADILTEEQMLAAVVFGHQQQQVVIEAVKEFAKEAGKPRWDWVAPQPNTDLINKVKAIAEARLGDAYRITEKQARYEQIDAIKADVIAQITAEDEEISESKIVDIFTALESQIVRGRIIAGEPRIDGRTVDTVRALDICTGVLPRTHGSAIFTRGETQALAVATLGTERDAQIIDELTGERQDHFLFHYNFPPYSVGETGMIGSPKRREIGHGRLAKRGVAAVMPSLAEFPYVVRVVSEITESNGSSSMASVCGASLALMDAGVPIKAAVAGIAMGLVKEEEKFVVLSDILGDEDHLGDMDFKVAGTREGVTALQMDIKIEGITPEIMQIALNQAKSARMHILGVMEQAIPAPRADISDYAPRIYTMKIDPKKIKDVIGKGGATIRSLTEETGTSIDIDDDGTVKIAAVDSNAAKNVMGRIEEIVAEVEAGAIYKGKVTRLADFGAFVAIVGNKEGLVHISQIAEERVEKVSDYLQVGQEVNVKVVEIDRQGRIRLTMKDLAPKQETEINQEDPVEEQE

SEQ ID NO: 2881 - protein, 314 aa, H. influenzae strain 86-028NP
MRCFRLSRHFIVYLFSLCAILLLAGCVQSRGGFVSKNHVVLAEQNPNTHFEQEVMIVRLSQVLLVGKMSNEERASLHFERGVLYDSLGLWGLARYDLTQALALQPKMASVYNYLGLYLLLEEDYDGALDAFNTVFELDSGYDYTHLNRGLNFYYVGHYHLAQQDFLQFYQADKKDPYRVLWLYLNEQKLKPQEAQTNLVERAKGLSEDFWGTHIVQYYLGHISVEELQQRASEFAENSQQYAEILTETYFYLAKQKLNVGLVDEAAALFKLAMANQVYNFVEYRFAAFELMKLKPVQTEDEKEEKSAVTKAIVF

SEQ ID NO: 2882 - protein, 613 aa, H. influenzae strain 86-028NP
MTDKITFNDLGLPEFILKAVSDLGFETPSPIQQACIPHLLNGNDVLGMAQTGSGKTAAFALPLLAQIDPSEKHPQMLVMAPTRELAIQVADACEQFVKYAHGTRIVTLYGGQRYDIQLRALKQGAQVVVGTPGRILDHIRRRTLNLSELRFIVLDEADEMLRMGFIDDVETVMAELPENHQTALFSATMPEPIRRITKRFMNDPQEVKIKVNNENAPDIDQSCWYVHGVRKNEALLRFLEVEDFDAAIIFARTKTGTLDITELLEKNGFRSAALNGDMTQQLREQTLDRLRNGSLDIVVATDVAARGIDIERISLVVNYDIPLDAESYVHRIGRTGRAGRSGRALLFVEPRERRLLRNIEHLMKKGINEVELPNHLVLQECRRKKFVAKITKQLEHHDLEQYRSLLEDLFTADQDQEDIAAAMLMLLQGKQKLILPPDPPMEKRRRERNDRGDRRENPRSAERRGERKGYGNPQPMDLYRIEVGRADGVEVRHIVGAIANEGDINSRYIGHIKLYDDYTTVELPQGMPKELLQQFAKTRVLNKQMQMSFLGAVKSDNSRGSDDFNGKRKGRGGDFRGERGRERGNDNRGNRKFNEKSNRTFSDKPRRDRRSSF

SEQ ID NO: 2883 - protein, 462 aa, H. influenzae strain 86-028NP
MVFPWQFLRHTEENHYTAIQARGSLYVGTINNQISYFINKDSERGFEYELAKAFADTLGVELEMKIFDNQEQLFDELDKHNIDLAAAHLLYHPKNAERFQIGPAYHSASWQLAYRKNENRPKNLGNVKKDIYISNNLALEETLKELQKQYPQLTWKRNQALTQEELLLQLAEGKIPYVIANSIDIAAIQQIKPELAIAFDITDEANVHWYLPNSPYRDLQTALLNFMNNAEETGLLDNLKEKYLGHISQFDYVDTRSYMNAIENTLPQFSPLFEKYKGELDWRLLAAVAYQESHWNPDATSPTGVRGIMMLTKNTAQHMKISDRTDPEQSIKAGSEYLHWLISQLPESIEKEERIWFALVAYNIGLGHLIDARRLTQNLGGNPDNWLNVKKNLPLLAEKRYYSQLKYGYARGYEAYQYVENIRRYMNSIVNYHRVQENQTTNDNANNESAVKNLEEIKENKD

SEQ ID NO: 2884 - protein, 50 aa, H. influenzae strain 86-028NP
MLKRKTFLKKKANLQQSSLSRNLRLRRLKHRKQQQFSRHSLQFVVQEICC

SEQ ID NO: 2885 - protein, 98 aa, H. influenzae strain 86-028NP
MSKQPQILLNNTWNVRISDPGEEGAKSHFFETIYLTLTAYFEENNIRYEFVRKVEDQIKIQRSFTELNELFKFLGDYFDPVSIGLVGVKIGNLGIKLE

SEQ ID NO: 2886 - protein, 69 aa, H. influenzae strain 86-028NP
MRKKQKSAVENETVYLHTRGVIKDNAVMALLGDKLFRQRVEKKRKGKGSYQRKAKHPGKIFEKPDYKFF

SEQ ID NO: 2887 - protein, 116 aa, H. influenzae strain 86-028NP
MSVIIYHNPHCSKSRETLALLENKGIQPIIELYLQKQYSVNELQSIAKKLGIDDVRQMMRTKDELYKSLNLDNLDLSQAELFKAMSEHSALIERPIVINGDKAKIGRPPETVLEIL

SEQ ID NO: 2888 - protein, 349 aa, H. influenzae strain 86-028NP
MLEMLKSWYSRRLSDPQAMGLLAILLFGFISIYFFGDLIAPLLIALVLSYLLEMPINFLNQYLKCPRMLATILIFGSFIGLAAVFFLVLVPMLWNQTISLLSDLPAMFNKSNEWLLNLPKNYPELIDYSMVDSIFNSVREKILGFGESAVKLSLASIMNLVSLGIYAFLVPLMMFFMLKDKSELLQGVSRFLPKNRNLAFKVWKEMQQQISNYIHGKLLEILIVTLITYIIFLIFGLNYPLLLAFAVGLSVLVPYIGAVIVTIPVALVALFQFGISPTFWYIIIAFAVSQLLDGNLLVPYLFSEAVNLHPLIIIISVLIFGGLWGFWGVFFAIPLATLVKAVINALPQD

SEQ ID NO: 2889 - protein, 325 aa, H. influenzae strain 86-028NP
MMKLFTKDKDGHFIREINGIKLPFPLTEFMKVRKWGYILSALLMVISLFFIITKGFNWGLDFTGGVVFDTHFSQSANLEQIRSKLHENGIESPVVQTTGSVQDVMIRLPASNNDSTIGEHVKSMLQNVDKDIQIRSIEFVGPNVGEELAQGAVYATLATLAMVLIYVGSRFEWRLGFGSIASLAHDVIITLGVFSALQIEIDLTFVAAILSVVGYSINDSIVVFDRVRENFRKIRRLDTIDIIDISLTQTLSRTIITSVTTLVVVMALFFFGGPSIHNFSLALLVGIGFGTYSSIFVAIAIAYDVGLRREHMIPPKVDKEIDELP

SEQ ID NO: 2890 - protein, 616 aa, H. influenzae strain 86-028NP; identical to SEQ ID NO: 721

SEQ ID NO: 2891 - protein, 97 aa, H. influenzae strain 86-028NP
MEAQSPMSTLFIFVIFGLIFYFMIYRPQAKRNKEHKKLMSELAKGTEVLTAGGLIGKITKVTEGSDSIVIALNDTTEITINRNYIVSVLPKGSLKSL

SEQ ID NO: 2892 - protein, 73 aa, H. influenzae strain 86-028NP
MKYQLNLTALRCPIPLLSAKKALKNLNKNDELMLILNLESAVENFSIFAEENSVALVEQYYASEKEFIVILKK

SEQ ID NO: 2893 - protein, 172 aa, H. influenzae strain 86-028NP
MQILEPQQFATWNEPIEMLYACHSKVKRFCRQLSILPDYLEKHGYTQAVLNDVEQILTYFNRAAPLHHDDEESDFFPQLVKVAPQAQTSIDELEKQHEYLHENWNALSVQLEELISEQRQNIDEYLIERFIQGYDRHIALEEPLFEMGRECLSADILTEMGKRMSARRQVKE

SEQ ID NO: 2894 - protein, 382 aa, H. influenzae strain 86-028NP
MKYELDKTSGNARRGRLVFERPQGTFSVETPAFMPVGTYGTVKGMTPEEVRATGAEILLGNTFHLWLRPGQEIMRKHGDLHDFMQWHRPILTDSGGFQVFSLGKLRKITEEGVKFQNPINGERIFLSPEKSMEIQYDLGSDIVMIFDECTPYPATFDYAKKSMEMSLRWAKRSHDRFDELGNKNALFGIIQGGVFEELRKVSLEGLVNIGFDGYAVGGLAVGEPKEDMHRILEYICPQIPADKPRYLMGVGKPEDLVEGVRRGIDMFDCVMPTRNARNGHLFVTDGIVKIRNAKYRDDTSPLDPECDCYTCKNYTKAYLYHLDKCGEILGARLNTIHNLRYYQRLMAEIRQAIEDDRFDDFVVEFYARMGKPVPPLQLADNS

SEQ ID NO: 2895 - protein, 363 aa, H. influenzae strain 86-028NP
MRVSDFNFDLPDELIARYPKTDRVSCRLLQLNGENGEIFHRTFSDVLDLIDQGDLLIFNNTHVIPARMFGRKASGGKIEVLVERMLDEHRFLAHIRSSKSPKEGAELFLGEDKLGENNGIKAVMKARHSSLFEVELSDKSTALLDVLQTIGHMPLPPYIDRPDEEADKECYQTVYSKVPGAVAAPTAGLHFDKNLLEKLKAKGVNFEFVTLHVGAGTFQPVRVENIEDHVMHAEYVEVSQEVCNAIIATKKAGKRVIAVGTTSVRSIESAALSAEEFGNPDLIEPYFSDTSIFIYPGKKFRVVDCLITNFHLPESTLIMLVSAFAGYKNTMNAYKHAVQEKYRFFSYGDAMFINKNSNVRELE

SEQ ID NO: 2896 - protein, 148 aa, H. influenzae strain 86-028NP
MNLTKILPTFAAVVVLSACAKDAPEMTKSSAQIAEMQTLPTITDKTVVYSCNKQTVTAVYQFENQEPVAAMVSVGDGIIAKDFTRDKSQNDFTSFVSGDYVWNVDSGLTLDKFDSVVPVNLIQKGKSSDNIIVKNCDVNVKATKKANL

SEQ ID NO: 2897 - protein, 1392 aa, H. influenzae strain 86-028NP
MKKTVFRLNFLTACISLGIVSQAWAGHTYFGIDYQYYRDFAENKGKFAVGAKDIEVYNKKGELVGKSMTKAPMIDFASVARSGYAALVGDQYIVSVAHNGGYTNADFGAEGQNPDQHRFTYQIVKRNNYKPDQKHHYNGDYHMPRLHKFVTESSPFDMTGSMKGQTYADKEKYPMRVRIGSGDQYWRNEQDKGTQVAEAYGYLIAGNTHMQTGAGNGDVSLSGDVRKGNDYGPMPTAGSFGDSGSPMFIYDATEKKWLINGVLRTGNPSLGRENTFQLVRKNYFDEIFSANLKTTIFDFRTPKNQQNQHYTFHSKNDGSGTITSGAGKIYKVKLANYNLSMKGTEPVYTNGGVNNYSPALSHGENLYFIDYGKGVLTFSNNIDQGAGGLYFEGDFIVSPTHNETWKGAGISISDESTVIWKVNGVENDRLSKIGKGTLHIQAKGKNLGSISVGDGKVILEQQEDDQHKKQAFSEIGLVSGRGTVQLNDDKQFDTDKFYFGFRGGRLDLNGHSLTFKRIQNTDEGAMIVNHNTTEVANVTITGNESIVLPNGNNINKLNYSKEIAYNGWFGETDENKHNGRLNLIYKPTTEDRTLLLSGGTNLKGDITQEGGTLVFSGRPTPHAYNHLNRPNELGRPQGEVVIDDDWINRTFKAENFQIKGGSAVVSRNVSSIEGNWTISNNANATFGVVPNQQNTICTRSDWTGLTTCKTENLTDTKVINSIPTTQINGSINLTDNATANVKGLAKLNGNVTLTNHSQFTLSNNATQIGNIRLSDNSTATVDNANLNGNVHLTNSAQFYLKNSHLSHQIQGDKGTTVTLENATWTMPSDTTLQNLTLNNSTVTLNSAYSASPNNTPRRRRRSLETETTPTSAEHRFNTLTVNGKLSGQGTFQFTSSLFGYKSDKLKLSNDAEGDYILSVRNTGKEPETLEQLTLVESKDNQPLSDKLTFTLENDHVDAGALRYVLVKNNGEFRLHNPIKEQELHNDLVRAEQAEQTLEAKQVEPTAETQTSKAKVRLRRAVLPDTLPAQSLLNALEAKQAEPNAKTQKSKAKTKKARSKRALRAVFSDPPPDQSQLDVLKAALEVINAQPQVGKERQAQEKQGKQKDLISRYSNSALSELSATVNSMLSVQDELDRLFVDQAQSAVWTNIAQDKRRYDSDAFRAYQQKTNLRQIGVQKALDNGRIGAVFSHSRSDNTFDEQVKNHATLTMMSGFAQYQWGDLQFGVNVGAGISASKMAEEQSRKIHRKAINYGVNASYQFRLGQLGIQPYLGVNRYFIERENYQSEDVKVQTPSLAFNRYNAGIRVDYTFTPTDNISVKPYFFVNYVDVSNANVQTTVNSTMLQQSFGRYWQKEVGLKAEILHFQLSAFISKSQGSQLGKQQNVGVKLGYRW

SEQ ID NO: 2898 - protein, 943 aa, H. influenzae strain 86-028NP
MENIDIRGARTHNLKNINLTIPRNKLVVITGLSGSGKSSLAFDTLYAEGQRRYVESLSAYARQFLSLMEKPDVDSIEGLSPAISIEQKSTSHNPRSTVGTITEIYDYLRLLFARVGEPRCPDHNVPLTAQTISQMVDKVLSLPEDSKMMLLAPVVKNRKGEHLKILENIAAQGYIRARIDGEICDLSDPPKLDLQKKHTIEVVVDRFKVRSDLATRLAESFETALELSGGTAIVADMDNPKAEELIFSANFACPHCGYSVPELEPRLFSFNNPAGACPTCDGLGVQQYFDEDRVVQNPTISLAGGAVKGWDRRNFYYYQMLTSLAKHYHFDVEAPYESLPKKIQHIIMHGSGKEEIEFQYMNDRGDVVIRKHPFEGILNNMARRYKETESMSVREELAKNISNRPCIDCGGSRLRPEARNVYIGKTNLPIIAEKSIGETLEFFTALSLTGQKAQIAEKILKEIRERLQFLVNVGLNYLSLSRSAETLSGGEAQRIRLASQIGAGLVGVMYVLDEPSIGLHQRDNERLLNTLIHLRNLGNTVIVVEHDEDAIRAADHIIDIGPGAGVHGGQVIAQGNADEIMLNPNSITGKFLSGADKIEIPKKRTALDKKKWLKLKGASGNNLRNVNLDIPVGLFTCVTGVSGSGKSTLINDTLFPLAQNALNRAEKTDYAPYQSIEGLEHFDKVIDINQSPIGRTPRSNPATYTGLFTPIRELFAGVPEARARGYNPGRFSFNVRGGRCEACQGDGVLKVEMHFLPDVYVPCDQCKGKRYNRETLEIRYKGKTIHQVLDMTVEEAREFFDAIPMIARKLQTLMDVGLSYIRLGQSSTTLSGGEAQRVKLATELSKRDTGKTLYILDEPTTGLHFADIKQLLEVLHRLRDQGNTIVVIEHNLDVIKTADWIVDLGPEGGSGGGQIIATGTPEQVAKVESSHTARFLKPILEKP

SEQ ID NO: 2899 - protein, 168 aa, H. influenzae strain 86-028NP
MAGINKVIIVGHLGNDPEIRTMPNGDAVANISVATSESWNDRNTGERREVTEWHRIVFYRRQAEICGEYLRKGSQVYVEGRLKTRKWQDQNGQDRYATEIQGDVMQMLGGRNQNASGSGNDMGGTPQSSYQARQTNNGNSYQSSRPAPQQSAPQAEPPMDGFDDDIPF

SEQ ID NO: 2900 - protein, 264 aa, H. influenzae strain 86-028NP
MQQTKRSLLGLLISLIAHGIIIGFILWNWNEPSDSANSAQGDISTSISMELLQGMVLEEPAPEPEDVQKEPEPEPENVQKEPEPEKQEIVEDPTIKPEPKKIKEPEKEKPKPKEKPKNKPKKEVKPQKKPINKELPKGDENIDSSANVNDKASTTSAANSNAQVAGSGTDTSEIAAYRSAIRREIESHKRYPTRAKIMRKQGKVSVSFNVGADGSLSGAKVTKSSGDESLDKAALDAINVSRSVGTRPAGFPSSLSVQISFTLQ

SEQ ID NO: 2901 - protein, 147 aa, H. influenzae strain 86-028NP
VKKFDEINIIPFIDIMLVLLTVVLITASFISQGKIQVNVPKASTAVAFKSDELAKLLTVTADKQLYFNDKPISQEALEAEIAQWNKDQKVTLKIDAEASFQDFVTITDMLSKNEIKNVAIVSMKDKGKSAGENSQESTPSQSVPTTP

SEQ ID NO: 2902 - protein, 150 aa, H. influenzae strain 86-028NP
MVQLFDFLQQYSDYFIIGLLLLMSIIMLAMVIERYLFLRKVSVAHYSTIHALDIDLNRNMTVISTIGANAPYVGLLGTVIGILLTFYQIGHGGGDIDPSVIMLHLSLALKATALGILVAIPSMVFYNGLGRKVEVNRLKWKVLSEQKDKE

SEQ ID NO: 2903 - protein, 155 aa, H. influenzae strain 86-028NP
MNPLSVGNQAPAFTLLNQQEKFVSLSDFRGKKVLIYFYPKALTPGCTTQACGLRDSKSELDALGLVVLGISPDAPKKLAQFIEKKALNFTLLSDPDHQVAEQFGVWGEKKFMGRTYDGIHRISFLINESGTIMQVFDKFKIKDHHQMIIDYLRSL

SEQ ID NO: 2904 - protein, 298 aa, H. influenzae strain 86-028NP
MSAQNPLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATGDVSRIVKIKQLAGKNFIVLSGNDTTGLEAIKLGAEGVISVTNNIAAKDMADMCRYALAGDFDKAEEINARLMRLHHDLFIESNPIPVKWAAYRLGLIKSPHLRLPLTTLSEEIQPKVEDALKIAGLL

SEQ ID NO: 2905 - protein, 209 aa, H. influenzae strain 86-028NP
MKKIILNLVTAIILAGCSSNPETLKATNDSFQKSETSIPHFSPLATGGVQLPKADDAYSLPNIEVKKGEDIDIRPPLIPLAIIQNSITKFDGERSLIVYPKQQAKLYNLQQVKRLLKDEGISSTTDGSILTTDWAKTERIGDKSIEIKYQIEQVMTADVSVLTVSILHMRRDGIIFTPNVSDKQYYTSERLNRIVLTLTTAYNKQLQDL

SEQ ID NO: 2906 - protein, 107 aa, H. influenzae strain 86-028NP
MTLNITSKQMDITPAIREHLEERLAKLGKWQTQLISPHFVLNKVPNGFSVEASIGTPLGNLLASATSDDMYKAINEVEEKLERQLNKLQHKSESRRADERLKDSFEN

SEQ ID NO: 2907 - protein, 312 aa, H. influenzae strain 86-028NP
MTDRQTDRQTDRQTINIIFSSDNHYAPYLAVSIFSIIKNTPEKINFYILDMKINQENKTIINNLATAYFCKVFFLPVSEADFQNFPKTIDYISLATYARLNLTKYIKNIEKAIYIDVDTLTNSSLQELWNIDIMNYYLAGCRDTFIDVKNEAYKKSIGLEGYSYFNAGILLINLNKWKEENIFQKSINWMNKYNNVMKYQDQDILNGICKGKVKFINNRFNFTPTDRGLIKKKNLLHVKMPIVISHYCGPNKFWHKKCSHLNCHIGNLLLKEMDKIIDIPSSWYDHFEKIPFLIKIKRLRKRIKDKLIYGIY

SEQ ID NO: 2908 - protein, 195 aa, H. influenzae strain 86-028NP
MKQKIVLATGNKGKVKEMADVLSDFGFEVIAQTDLGIESPEETGLTFVENALLKARYASEKSGLPAIADDSGLVVSALNGAPGLYSARYAGEEGNDAKNREKLLAELAHVAKDQRQAKFVSCIVFLQHPTDPSPIIAEGECCGVIGFEEKGENGFGYDSLFFSPEQGCTFAELETAEKKKISHRAKALNILKNKL

SEQ ID NO: 2909 - protein, 241 aa, H. influenzae strain 86-028NP
MHQFQQDNQYFIFNFDRTFEQATEFFQAEFWQKQERVIGSAKGRGTTYFLQTEDWFGVNCALRHYYRGGLWGKLNKDRYRFSALETTRSFAEFHLLQRLYEAGLPVPKPIAARIQKGKLGICYQADILTEKIENAQDLTALLQTQTLPKETWRQIGRLIRKLHDLQICHTDLNAHNILLQQAEQEQKCWLIDFDKCGKKSGDFWKAQNLNRLKRSFEKEVGRMNIQFTEQNWADLTAAYHQ

SEQ ID NO: 2910 - protein, 347 aa, H. influenzae strain 86-028NP
MPFFTEAPKSLCILRLSAVGDVCHALAVVQHIQAYYPQTEMTWIVGKTEMGLLSGIPNITLIPYDKKAGWKGVLLFWKQLKNKQFDALLNMQTAFRASILSLGIKAKFKIGFGEKRSREGQWLFVNRRITDPFSPHVLDGFMAFAEYIGVPKSEPKWELAISQDDDKFADQFIDFSRKNLLISPCSSKAEKDWLIERYAEIANIAHQHNINVIFCSSPAKRELEIVEKITALCHFTPTNIAGKTNLKQLTALISKVDLVLSPDSGPAHIATTQGTPVIGLYAYHNPLRTAPYNNLDNVVSVYEENAQKEFGKPSSELPWATKLKGKNLMAEIQVEPVIEQMKKLGLF

SEQ ID NO: 2911 - protein, 709 aa, H. influenzae strain 86-028NP; identical to SEQ ID NO: 757

SEQ ID NO: 2912 - protein, 565 aa, H. influenzae strain 86-028NP; identical to SEQ ID NO: 755

SEQ ID NO: 2913 - protein, 921 aa, H. influenzae strain 86-028NP; identical to SEQ ID NO: 733

SEQ ID NO: 2914 - protein, 118 aa, H. influenzae strain 86-028NP
MDRVFIEELTVFAQIGVYDWEQQIKQKLVFDLEMAWDCKQAAETDDVVYCLNYAEVSQAIIDYVESKSFLLIERVAYEVADLLESRYQLQGLKIKLSKPKAVAQARNVGVLVIRGCLK

SEQ ID NO: 2915 - protein, 199 aa, H. influenzae strain 86-028NP
MSLFALFYMLFAYLLGSISSAILICRIAGLPDPRQNGSHNPGATNVLRIGNRKSALAVLIFDMLKGMIPVWAGYYLGLTQFELGMVALGACLGHIFPIFFQFKGGKGVATAFGAIAPISWAVAGSMFGTWIFVFLVSGYSSLSAVISALLVPFYVWWFKPEFTFPVALVCCLLIYRHHDNIQRLWRGQEDKVWAKFKKK

SEQ ID NO: 2916 - protein, 567 aa, H. influenzae strain 86-028NP
VYTKGSVSTRIAKYLFIILIVAGVISSLSLAIMSSNKYDAEAINISGSLRMQSYRLLYEMQEQPESVETNLRRYHISLHSSALLEVQNQFFTPNVLKHSYQNILQRWTNMEKYARQQDVKNYSKQLTNYVADVDYFVFELQRFSEQKWILGVSVLGFAMLLILLMVSYVIWYTNREVVKPLHLMTKASMQVQMRQFNHIPLDTRKQNELGTLARVFTQMSTELGQLYSRLEEAVNEKTQKLRQTNRTLSTLYQSAQLLNTNTINDKILNQVLHYIFISDHLNFVKVEVMGAEHWDITLGKQDANNELQIETLSVDNEELGVLSWQAGLPCPDPRIMQNLAQMLARALYFHKNLRQKEQILLMEERSIIARELHDSLAQVLSFLQIQLTLLKHNLKKEDEQSKEKSLAIIANFEQALSGGYAQLRELLATFRLTIQEANLQLALKQVIDSLRSQTTMQMNVNCQLPSQSLNPQQLVHVLQIVREATTNAIKHSQGTVIEISARINAEGEYEILVEDDGVGIPNLEEPEGHYGLNIMAERCRQLNAQLHIHRREQGGTQVKITLPHTLY

SEQ ID NO: 2917 - protein, 341 aa, H. influenzae strain 86-028NP
MQNLQPFHTFHIQSNAREIIEAHSIEQLQQVWANSKSENLPVLFLGQGSNVLFLDDFNGVVVLNRLMGITHEQDANFHYLHVNGGENWHKLVEWSINNGIYGLENLALIPGCAGSAPIQNIGAYGVEFKDVCDYVDVLNLNTNETFRLDTEQCEFGYRESTFKHRYQQGYVITAVGLKLKKDWQPILKYGSLVDFDPKTITAKQIFDEVCHIRQSKLPDPNETGNAGSFFKNPVVSSEHFEEIKKHHKNLPHFPQADGSVKLAAGWLIDQCNLKGFQIGGAAVHKKQALVLINKSGATGQDVVKLAHHVRQTVAEKFGVYLQPEVRFISATGEVNSEQIIT

SEQ ID NO: 2918 - protein, 281 aa, H. influenzae strain 86-028NP
MDKETQMMLVPQGSIEGYIRAANEYPMLTAEEEKELAERLYYHEDLDAAKKLILSHLRFVIHVARGYSGYGLPQADLIQEGNIGLMKAVKRFNPEVGVRLVSFAVHWIKAEIHEYVLRNWRIVKVATTKAQRKLFFNLRKTKQRLGWFNENEVDMVANELGVSKEDVIEMESRMSGADVGFDLPTDDAETETYSPALYLEDKSSNFAAELENENFESQATEQLGAALQSLDARSQDIIKARWLDDNKATLHDLAAKYNVSAERIRQLETNALKKLKSAVNF

SEQ ID NO: 2919 - protein, 288 aa, H. influenzae strain 86-028NP
MGFIGKIIGVFLGWKVGGFFGAIAGLILGSIADKKLYELGSVSSSFFKKKTTRQDLFMQTTFAVLGHLSKSKGRVTEEDIQLANQLMIQLKLDDAGRKLAQDAFRRGKESDFPIRQVIREFRIGCGQRADLLRMFLQVQVQAAFADSELHENEKEVLYVIAEELGLSRMQFEQMIAMEMAARAFTQGGFYQQYQQGAYQGGYQYQQQNSGGYQHASGPTLNDAYKVLGVTESDEQSTVKRAYRRLMNEHHPDKLVAKGLPPEMMEMAKEKTQQIQAAYDLICKAKGWK

SEQ ID NO: 2920 - protein, 213 aa, H. influenzae strain 86-028NP
MEQYKRDFIEFALSRNVLKFGEFTLKSGRKSPYFFNAGLFNTGADLARLGEFYAAAIQASAVDFDVVFGPAYKGIPIGTSVSVALFNRYGIDKPVCFNRKEVKDHGEGGNLIGSPLQGKILLVDDVITAGTAIRESMELISANKAELAAVLIALNRKERGKGELSAIQEVERDYQCQVLSIIDLDDLMQFIEQDPRYSSHLPEMRAYRAEFGV

SEQ ID NO: 2921 - protein, 238 aa, H. influenzae strain 86-028NP
MRPNNRENNQPRQIKITRNYTKHAEGSVLVEFGDTKVLCTATVEDAVPRFLKGQGQGWVTAEYGMLPRSTHSRMQREAAKGKQGGRTMEIQRLIARSLRAMVDLKALGERAITLDCDVIQADGGTRTASITGAAVALCDAINGLIENGTLKTNPIKGLVSAISVGIVDGQAVCDLEYVEDSAAETDMNVVMMEDGRMIEVQGTAEGEPFSHEELLTLLDLAKQGCNQIFIAQREALGL

SEQ ID NO: 2922 - protein, 480 aa, H. influenzae strain 86-028NP
MKLDAPFNLDPNVKVRTRFAPSPTGYLHVGGARTALYSWLYAKHNNGEFVLRIEDTDLERSTPEATAAIIEGMEWLNLPWEHGPYYQTKRFDRYNQVIDEMIEQGLAYRCYCTKEHLEELRHTQEQNKEKPRYDRHCLHDHNHSPDEPHVVRFKNPTEGSVVFDDAVRGRIEISNSELDDLIIRRTDGSPTYNFCVVVDDWDMGITHVVRGEDHINNTPRQINILKAIGAPIPTYAHVSMINGDDGQKLSKRHGAVSVMQYRDDGYLPEALINYLVRLGWGHGDQEIFSREEMINYFELDHVSKSASAFNTEKLQWLNQHYIRELPPEYVAKHLEWHYKDQSIDTSNGPALTDIVSMLAERCKTLKEMASSSRYFFEEFETFDEAAAKKHFKGNAAEALAKVKEKLTALSSWNLHSIHEAIEQTAAELEVGMGKVGMPLRVAVTGSGQSPSMDVTLVGIGRDRVLVRIQRAIDFIHAQNA

SEQ ID NO: 2923 - protein, 551 aa, H. influenzae strain 86-028NP
MIAYIFLALFTIAAVIFIVNSHYRWTYFFAITLFTFLFGGMLMVSSQWQRALNFSSVLFVVLMLFHRLKIHYYKQPLLISDFFLVVDWRNWETLIHYKGALFGVIGLLALLGYAIFGFNDVESLGVLGNSIGALLFIVSFSLMWHYSKNPSAVQVWLDSLPDDGRDVFLNLPMSCRGIFFKVPNFDGNSQNFIEKMTALSSDTNNLSETKPDIVVTLMESTLNPHQFAFSQQSIPPLSMFESQSDTVFASPLRVHTFAGATWKSEFAFLAGVPSTDFGALASGVFYSVVPHLQSGLVKNLKAQGYFCVALSPFTKGNYNAKSAYDHFGFDLMLQPQDLGYPAPISKNLWDISSEEMMKYTRMILEKQHPALENVDQPMFVYVLTMREHGPYELGMENIFNLQMPNLGAKSISALNDYTQRIVALNDAIEGMNNYLQERKKPFVLGYFGDHQVAFDNAIPPKKGDYAQPDYVTQFVVRSNYASQFKQEQKFLDLAFAGGVLMNVAGLSAEDEFMKANMAMCKLSHGKLEDSSDIQLLNDYRHYLYQTLAIAR

SEQ ID NO: 2924 - protein, 269 aa, H. influenzae strain 86-028NP
MISLKNFGLLFWKRFSENKLNQVAGALTYSTMLAIVPLVMVIFSIFSAFPVFNEVTGELKEMIFTNFAPSASDMVGEYIDQFVSNSKKMSAVGIVSLIAVALMLINNIDRTLNSIWHNSQSRSPLSSFAIYWMILTLGPLIIGVSIGISSYIKIMFEQSEHLSLGLKLLSFVPFLFTWFIFTLIYTVVPNKKVKIKHSAYGAFLAAIFFTLGKQAFTWYVVTFPSYQLIYGAMATLPIMLLWIQISWLVVLVGAQLASTLDEIGEQIEQ

SEQ ID NO: 2925 - protein, 161 aa, H. influenzae strain 86-028NP
MSEISTALSLENCPCQSSHHYADCCGKFHLRQAFPETAEQLMRSRYTAYVLKNIPYIVVTTAPSQQTLLKPRLLQEWADNTTWLGLEILKTESLTKTQSAVEFKAIFQGEEGELAHQERSIFVKIENRWYFVDPTVSLPTMKQPCVCGYGKKFKHCCGGFL

SEQ ID NO: 2926 - protein, 220 aa, H. influenzae strain 86-028NP
MNAKILVIKVGQVETLTFSDGSQYESAIRKKVVPSVKIHSLGAEGNDVGLKKHHGGVDKALFFMSADSFNELNTLLNKDFSYMDTAIYGENFVVSGLNEDNVCIGDRYQIGSTILEVSQPRKPCERLSKNTENEDTRDIVYQTGLSGWYVRIIETGTIKQKDELKLLARPYPQITIRHLNRLLSAPENEAELDAALEIEVLAEAFKRSIRSQISKFKQQG

SEQ ID NO: 2927 - protein, 259 aa, H. influenzae strain 86-028NP
MIIRRFIMSDVFHLNLTKAQLKGATLAIVPGDPARSERIAKQLDNPEFLTSTREFTSWLGYINGQPIVVCSTGIGGPSTSICVEELAQLGVRTFLRIGTTGAIQPHINVGDVLITTAAVRLDGASCHFVPLEYPAVANFECTTALYNAAKAKGIEPYVGVTVSSDTFYPGQERYDTYSGKVYRDYQGLLKQWQDLNVMNYEMESSTLFTMCSALGLRAGMVAGVIVNRTQQEIPNEATIKQTEEKAVSVVIAAAQALLS

SEQ ID NO: 2928 - protein, 438 aa, H. influenzae strain 86-028NP
MSTQLRNNPMKVALASMVGTAIEFFDYYIYAAAAVLVFNTQFFHSDDPLSNDLLSLSTLALAFFARPIGSALFGHFGDKIGRKKTLVASLVLMGGSTVVIGLLPNYAQIGIWAPILLCVCRVGQGIGLGGEWGGAALVATENAPEGKRAWYGTFPQLGAPIGLFVANGTFFLASYLLGHNALVEWAWRIPFVSSILLVAVGLYVRLTLHESHVFVEAEQKGKKLNAPVSVVFTKHLKPMIIGTFIMVATYSLFYIMTAFAQAYSRTVPKLSEAGYALGLGIPANTFTGLLLISAIVFGIFISISGFYADKIGRRKWLIWVTIAIGVLGLAMPLFLENGTPVSVFAFLVIGMAIMGMTFGPMAALLPELFPTEVRYSGASLAYNLASIIGATIAAMISLKINASFGVMGVGIYLAINALMTFLALLASKETKNVDLTEI

SEQ ID NO: 2929 - protein, 247 aa, H. influenzae strain 86-028NP
MINIIFLHGLLGTKNDWQKVIENLPHFNCIALDLPFHGQARDIEVTNFEETAEYLAKQIKSAVKNEPYFLVGYSLGGRIALYYALKAQVERSNLQGVILEGANLGLKTDEEKQARFQQDFAWAQRFIQEPPEKVLNDWYQQPVFSHLTAEERLQLVEKRKSNCGENIGKMLLATSLSKQPDFSEKVRLSSLPFFYFCGERDHKFQVLAKENQIDLVTIPCAGHNSHLENSKYFSKKIENCILKIVRP

SEQ ID NO: 2930 - protein, 568 aa, H. influenzae strain 86-028NP
MSVSVFNRCWSKVILETLVRQGVSHVCIAPGSRSTPLTLEAVRLQNAGSVTCHTHFDERGLGFFALGIAKATQSPVAIIVTSGTATANLYPAIIEARQTGVNLFVLTADRPPELWECGANQAILQQNMFGQYPVANVNLPKPNADYSAQWLISLLEQAAFQQKQQGGVVHINVPFTEPLYDATDEEVNSHSWLQPLQRWLIQNKSWINVEVQQNEVLMHENWDHWRTKRGVVVVGQLPAEQAMGINSWASAMGWVLLTDIQSGVVPTTPYEDIWLANQTVREKLLQADIVIQFGARFISKRINQFLQAFKGEFWLVEQSGKALDPYHHSLTRFNAKAHHWLRAHPPLRQKPWLLEPLALSKFCATFIEQQVGGNLTEASLALRLPTLLPYNGVLFLGNSLLVRLVDALTQLPESYPVYTNRGASGIDGLLATAAGIGIGSNKPVVAVIGDTSTLYDLNSFALFKNVTQPTLIFVINNNGGAIFDMLPVDEQVKDQFYRLPHNGDFSQIAAMFDLKYAHPYTWADLNSVVKQAYSRRKATLIEIKTNPSDGSSLYKRLIDQISHAVIGA

SEQ ID NO: 2931 - protein, 423 aa, H. influenzae strain 86-028NP
MSYLAQAIGELKSQIHAYLQQSTNELVRFQVKLDKVDLLAWLKGQSAYPQFYLHFRDEEKALAALGAVQSFSQLNLAQEFIEESGFPLVGGLQFQGTAQFVLPKMLVEQDNKGTLVSFFVKDEQSANDTLAHLKTFENLTALSALPKQIPLHTEPRANERTWCDWVNQALVEIKSGELTKIVLANETTFHLKQAINAYDFLAESEKQNQGCYHFLWAENSHSVFVGSTPERLFAREYNLLLTEALAGTASVSESEEETQSQANWLLNDEKNLKENWLVVEDISQNLRKQVESFDVSNVELKPLRKVQHLIRKIRANLTAHYADVNILKAIHPTAAVSGLPQQQAKMILSEIETFDRGWYAGTLGVMSDVCSEFCVAIRSAFIEGHRIRVFAGAGIVAGSQPLEEWKEIERKAAGLISLFAEEK

SEQ ID NO: 2932 - protein, 404 aa, H. influenzae strain 86-028NP
MRLFPKSDKLEHVCYDIRGPVHKEALRLEEEGNKILKLNIGNPAPFGFEAPDEILVDVLRNLPSAQGYCDSKGLYSARKAIVQYYQSKGILGATVNDVYIGNGVSELITMAMQALLNDGDEVLVPMPDYPLWTAAVTLSGGKAVHYLCDEEANWFPAIDDIKAKVNAKTKAIVIINPNNPTGAVYSKELLQEIVEIARQNNLIIFADEIYDKILYDGAVHHHIAALAPDLLTVTLNGLSKAYRVAGFRQGWMILNGPKHNAKGYIEGLDMLASMRLCANVPMQHAIQTALGGYQSINEFILPGGRLLEQRNKAYDLITQIPGITCVKPMGAMYMFPKIDVKKFNIRSDEKMVLDLLRQEKVLLVHGKGFNWHSPDHFRVVTLPYVNQLEEAITKLARFLSDYRQ

SEQ ID NO: 2933 - protein, 418 aa, H. influenzae strain 86-028NP
MTQQRSPSLLGGAMIIAGTAIGAGMLANPTSTAGVWFIGSILALIYTWFCMTTSGLMILEANLHYPTGSSFDTIVKDLLGKSWNIINGLSVAFVLYVLTYAYITSGGGITQNLLSQAFSSAESAVDIGRTSGSLIFCLILAAFVWLSTKAVDRFTTVLIVGMVVAFFLSTTGLLSSVKTAVLFNTVAESEQAYLPYLLTALPVCLVSFGFHGNVPSLVKYYDRDGRRVMKSIFIGTGLALVIYILWQLAVQGNLPRTEFAPVIEKGGDVSALLEALHKYIEVEYLSIALNFFAYMAISTSFLGVTLGLFDYIADLFKFDDSLLGRTKTTLVTFLPPLLLSLQFPYGFVIAIGYAGLAATIWAAIVPALLAKASRQKFPQASYKVYGGNFMIGFVMLFGILNIVAQIGANLGWFASFTG

SEQ ID NO: 2934 - protein, 455 aa, H. influenzae strain 86-028NP
MISVFDMFKVGIGPSSSHTVGPMKAGKQFIDDLIKRNQFEQTAEIHVDVYGSLSMTGRGHSTDIAIIMGLAGYLPHNVDIDMISGFIEKVKQTALLPINVGQKIVKFDFENNLIFHRTFLKLHENGMTITALDENRTELYRQTYYSIGGGFIVDEAHFGKEEKNTVQVPYPYKNAEDILKHCSDNGLMLSTVMLENEIALNGKEAVSAHLENVWKTMQACIEHGIHTEGILPGPLRVPRRAASLYRALQANTNLSNDPMRVIDWVNMFALAVNEENAAGGRVVTAPTNGACGIIPAVLAYYEKFISPLTPEIIERYLLAAGMIGSLYKMNASISGAEVGCQGEVGVACSMAAAGLAEILGGNPLQVCIAAEIAMEHNLGLTCDPVGGQVQVPCIERNAIASVKAINASRMALRRTTNPRVSLDKVIETMYETGKDMNAKYRETSQGGLAVKIVCN

SEQ ID NO: 2935 - protein, 412 aa, H. influenzae strain 86-028NP
MKSTEKLKWNKFDATWMLNLFGTAVGAGVLFLPINAGMGGFWPLVLMAIIVGPMTYFAHRGLAYFVLSSKNPGSDITEVVEEHFGKTAGKLITLLYFFAIFPILLIYGNGITNTVDSFIVNQLGMASPNRVILSFVLIAVLISVMLFNEKVMLKITEWLVYPLVLILFVLSIYLIPEWNSAVLYEFPTTGGFLTTLWLTIPVLVFSFNHSPATSSFTCSQFREYKTFEGAERHISHTEKGASTILLFFVMFFVFSCVLTLTPEELVAAKEQNISILSFLANKFDNPYISYFGPLVAFLAITSSFFGHYMGAREGLEGLYLKMKGESVNRKKLNYATALFFLLTLWGVAIINPSILGLIESLGGPIIAMILFIMPMYAIRKIPAMKRYSGRFSNVFVTIMGLIAISAVVYGLL

SEQ ID NO: 2936 - protein, 722 aa, H. influenzae strain 86-028NP
MLDLTPQSKKISIQIGGMTCQSCANRIEKVLNKKPFVQQAGVNFAVEEAQVVFDATQASETQIIEIIHKTGFSAHIKQANELPIEENTSIPWRLIILWIINIPFLIGMLGMIGGSHHLMLPPIWQFALASIVQLWLAIPFYCGAIGSIRGGLANMDVLVSTGTLTIYLYSAFMLFYHADHAMGHVYFEASVMVIGFVSLGKFLEDRTKKHSLNSLSMLLQLTPKKVTVLRNEKWTEIALDQVNIGEIIRANQGERIAADGIIESGNGWCDESHLTGESRPEEKQKGGKVLAGAMVTEGSIIYQANQLGSQTLLGDMMNALSDAQGSKAPIARFADKVASVFVPVVLVISLVTFALTYILTNDSVSSLIHAVSVLVIACPCALGLATPAAIMVGLGKAVNAGVWFKDAAAMEETAHVDTVVLDKTGTLTKGELEISALWQPQSAVYSEDDLYRFAAAVERQANHPIAKAIVQAAEQKMLEIPTALFSKMEVGQGIQAELEQVGTIKVGKPDYCGLILPKNLEDIWQIASIVAVSINDEPIGAFALTDTLKNDSLHAIQRLQQQNIDVVIMSGDQQSVVDYIAKQLGIKKAFGGLSPRDKAEQIQKLKAQGHIVAMVGDGINDAPALASANVSFAMKSGSDIAEQTASATLMQHSVNQLVDALFIARATLKNIKQNLFFALIYNILGIPLAAFGFLSPIIAGAAMALSSISVLMNALRLKKVRF

SEQ ID NO: 2937 - protein, 128 aa, H. influenzae strain 86-028NP
MNISEAAKLVGLSTKQIRDYEKMGLIKPAVRSLSGYRNYGESDLERLHFIRHSRNVGFSLHQIAQLLALQDNPKRSCREVKVLTAQHIATLNQQIEQLQKMVQKLQHWHDSCQGNGNPECSILNGLNG

SEQ ID NO: 2938 - protein, 105 aa, H. influenzae strain 86-028NP
MADWDGKYISPYAEHGKKSEQVKKITVSIPIKVLEILTNERTRRQLKSLRHATNSELLCEAFLHAFTGQPLPTDADLMKERNDEIPEDAKVLMRELGVDPESWEY

SEQ ID NO: 2939 - protein, 420 aa, H. influenzae strain 86-028NP
MHLTELKNTPVSDLVKLGEEQMGLENLARLRKQDIVFAILKQHAKSGEDIFGGGVLEILPDGFGFLRSADSSYLAGPDDIYVSPSQIRRFNLQTGDKIEGKIRPPKEGERYFALLKVDQVNDDKPEVSRSKILFENLTPLHANSRLRMERGNGSTEDLTARILDLASPIGKGQRGLIVAPPKAGKTMLLQNIAQSITHNYPDVELIVLLIDERPEEVTEMQRSVKGEVIASTFDEPATRHVQVAEMVIEKAKRSVEHKKDVVILLDSITRLARAYNTVTPASGKILSGGVDANALHRPKRFFGAARNVEEGGSLTIIATALVDTGSKMDEVIFEEFKGTGNMELHLSRKIAERRVFPAIDFKRSGTRKEDLLTTADELQKMWILRKILNPMDEVDAMEFLIDKLMMAKTNEEFFEVMKRS

SEQ ID NO: 2940 - protein, 230 aa, H. influenzae strain 86-028NP
MIYFTMFLLGGILGIALWFYLSGFITHLQQEIYATYVELFPQNSSPFQPHFASIQQKKCGHILRYFFSIGVGFIFLQIAFKDSIFTVWIGLTLIILWTISYLDWHYQLISTTPCLWLLTLGLFGADNNFSLLTLSESIKSAASFFIVFYAIYWIAKCYYRKEAFGRGDYWLAMALGSFIHLETLPHFLLLASVLGICFSLIHKKKKEFIPFAPFMNLSAIIIYLVKYYGY

SEQ ID NO: 2941 - protein, 406 aa, H. influenzae strain 86-028NP
MTKKLFYYQGSNALNQKQKGSIIADTKQQAHFQLISRGLTHIKLQQNWQFGAKPKNSEISELLNQLATLLQSVIPLKNSLQILQQNCTQIMLNKWLERLLQSIESGLAFSQAIEQQGKYLTQQEIQLIQVGEMTGKLAVVCKKIATHRSQSLALQRKLQKIMLYPSMVLGISLLLTLALLLFIAPQFAEMYSGNNAELPTITAILLSISNFLKQNIGILLFFVLSFFLFYYFYLKRQTWFHQKKNQLISITPIFGTIQKLSRLVNFSQSLQIMLQAGVPLNQALDSFLPRTQTWQTKKTLVNDMVLDKEVRSILQWVSQGYAFSNSVSSDLFPMEAQQMLQIGEQSGKLALMLEHIADNYQEKLNHQIDLLSQMLEPLMMVIIGSLIGIIMMGMYLPIFNMGSVIQ

SEQ ID NO: 2942 - protein, 464 aa, H. influenzae strain 86-028NP
MTSYALLHTQRVTAQNGEIFTISPDLWERNQQQQSLLLRYFALPLKEENNRLWLGVDSLSNLSACETIAFITGKPVEPILLESSQLKELLQQLTPHQMQVEEQVKFYQHQETHFEQEDDEPVIRLLNQIFESALQKNASDIHLETLADQFQVRFRIDGVLQPQPLISKIFANRIISRLKLLAKLDISENRLPQDGRFQFKTTFSDILDFRLSTLPTHWGEKIVLRAQQNKPVELSFAELGMTENQQQAFQRSLSQPQGLILVTGPTGSGKSISLYTALQWLNTPDKHIMTAEDPIEIELDGIIQSQINPQIGLDFSRLLRAFLRQDPDIIMLGEIRDEESARIALRAAQTGHLVLSTLHTNDAISAISRLQQLGIQQHEIENSLLLVIAQRLVRKICPKCGGNLINSCDCHQGYRGRIGVYQFLHWQQNGYQTDFENLRESGLEKVSQGITDEKEIERVLGKNS

SEQ ID NO: 2943 - protein, 149 aa, H. influenzae strain 86-028NP
MKLTTQQTLKKGFTLIELMIVIAIIAILATIAIPSYQNYTKKAAVSELLQASAPYKADVELCVYSTNETTNCTGGKNGIAADITTAKGYVKSVTTSNGAITVKGDGTLANMEYILQATGNAATGVTWTTTCKGTDASLFPANFCGSVTQ

SEQ ID NO: 2944 - protein, 186 aa, H. influenzae strain 86-028NP
MQKLKDIEQGILDCRQIQSPHFDKRPNPQDISLLVIHYISLPPEQFGGGYVDDFFQGKLDPKIHPYFAEIYQMRVSAHCLIERNGRITQYVNFNDRAWHAGVSNFQGREKCNDFAIGIELEGSNEQPFTDAQYFSLQELTNVIMKSYPKITKDRIVGHCDISPGRKIDPGQYFDWERYLSSVKQTV

SEQ ID NO: 2945 - protein, 299 aa, H. influenzae strain 86-028NP
MNDEQQNSNQPENTKKPFFQSLFGRFFQGELKNREELVEVIRDSEQNDLIDQNTREMIEGVMEIAELRVRDIMIPRSQIIFIEDQQDLNTCLNTIIESAHSRFPVIADADDRDNIVGILHAKDLLKFLREDAEAFDLSSLLRPVVIVPESKRVDRMLKDFRSERFHMAIVVDEFGAVSGLVTIEDILEQIVGDIEDEFDEEEIADIRQLSRHTYAVRALTDIDDFNGQFNTDFDDEEVDTIGGLIMQTFGYLPKRGEEIILKNLQFKVTSADSRRLIQLRVTVPDEHLAEMNNVDEKSE

SEQ ID NO: 2946 - protein, 522 aa, H. influenzae strain 86-028NP
MKNLNRILLSIKFMNKYLTYFIAFISGLVGVFAFSPFDYWPLAYVSLLGLLYVAKNPKKSTALLSTFLWAMGFFCFGVSWLNVSIHQFGGASLGVSYFLVGLLAAYLALYPMLFTYLVQRFKVQSAVIFAVIWTLTEFLRGWIFTGFPWLQFGYTQIDSPFYGLAPIFGVTGLTFFTLWASAVIFNLVSSLFKTKNFKLVLANALLLIIVGGLSAYSSRIHFVKSVENKAISVTLAQGNIEQNLKWDPNYFYSTLAIYQKLIAENLGKTDLIILPESALPTLENAITPFFEKLEHAAKETKTEIMIGTVFQDTKSGKLLNSIMTTGNPDFPYQPDTPNRYNKHHLVPFGEYVPLESILRPLNSVFNLPMSAFQSGEAVQPSLIAKKRAFSPAICYEIIFGEQVRQNLKQDTDYLLTLSNDAWFGDSIGPWQHLQMARMRALELGKPLIRATNTGISVFVDAQGKVLAQAPQFIETTLTYKIAPAEGKTPYSVLGNMPLYALSLLFLLLHSMMAFIRRKMNIL

SEQ ID NO: 2947 - protein, 245 aa, H. influenzae strain 86-028NP
MRIPRIYHPISLENQTQCYLSEDAANHVARVLRMTEGEQLELFDGSNHIYPAKIIESNKKSVKVEILGRELADKESHLKIHLGQVISRGERMEFTIQKSVELGVNVITPLWSERCGVKLDTERMDKKIQQWQKIAIAACEQCGRNSVPEIRPLMKLQDWCAENDGALKLNLHPRAHYSIKTLPTIPAGGVRLLIGSEGGLSAQEIAQTEQQGFTEILLGKRVLRTETASLAAISALQICFGDLGE

SEQ ID NO: 2948 - protein, 186 aa, H. influenzae strain 86-028NP
MMELQGKFLIAMPHLDDYFNRTVVFMCEHNEQGSMGLVINQPTDLSIAELYSKLNFMMKNDRTFGNEMVVAGGPVHTERGFILHKNTLNAFQHTYKVTKELSMTTSADVVETLGSTFAPEKYLVALGCSSWGAGQLEKEIRDNAWLVVSSNDQILFDMPYEDRYAAANQLLGIHPYNFALAQVGHS

SEQ ID NO: 2949 - protein, 139 aa, H. influenzae strain 86-028NP
MGITALAFDFGTKSIGCAIGQSITGTAQALPAFKAQDGIPNWEAIEKCLKEWKPDVVIVGLPLNMDGTEQDLTLRARKFANRLQGRFGVNVHLQDERLTTTQARSEIFERGGFKALKKGKIDGVSACLILESWFEYAEY

SEQ ID NO: 2950 - protein, 403 aa, H. influenzae strain 86-028NP
MAKKVKPLVDTEIKKAKASNKPYTLTDGYGLFLIISPTGSKSWRFNYYRPITKKRAKISLGLYPAITLSKARELREQYRQLLANKIDPQEYIKQHELLQLQRQNNTFFAISTQWKQKKVSEIKSVTLKSRWRTLEKYAFPYLGDNPIAEITPQQLHDTVIPLFERGVSHTGKLVIALVNEIMNFAVNKGIIEFNKCINVSKAFNVNRTTHHPTIRPEKLPEFMSALRHSHIDLMVKYLIEFSLLTITRPSEAANAQWNEIDFEKSLWNIPAERMKMKKAFTIPLSLQVLKILNKLKNISGRSRFIFQSQRYPERPLHSSSANAAIKRVGYKDQLTSHGLRSIASTYLSETFTEMNLEILEACLSHQSKNQVRNAYNRSTYLEQRKPLMNAWGDFVEECMKKSI

SEQ ID NO: 2951 - protein, 144 aa, H. influenzae strain 86-028NP
MGIRMNVHEKIRKLRETKHWSQEEMAERMSMSLNGYAKIERGETKLHLDKLEQIAQILDIDIVELINSGERNVFVQFNENSHFSSSFQGDNEKSLLIEIEKLKLSLSHCQQLLEEKEGLLNKLVEQKDNEIKLLREMVELLKKG

SEQ ID NO: 2952 - protein, 140 aa, H. influenzae strain 86-028NP
MLKSILKPIGHILKLLIKTALFLLSLLFILMLIIGFVDNKKIPTEFIVFGILGICYICYTFNSWANKPEVCPVCKSGKIELDSIKEIDRWLGKTKVRERMASGKTRERYIQCTKVKKRYTYCCQNPNCKHTYTKIREEEL

SEQ ID NO: 2953 - protein, 257 aa, H. influenzae strain 86-028NP
MFSTAIIEKINYYIYCLVDPRNQNIFYIGKGIGNRVFQHAQGALTCKTNENDKISLINDIHKDGLEPLYYILRHNIKEEKQALEYEALAIDLLSIVKPNQQPLTNIQGGTHSSEKGLMSLSELKHIYDPQELKTDLPVVLITINKNYKKLKQQIKSGEIDKSQIEKEIYERTRGYWKTGSRREKAKYAIAVYRGWTLAAYEISYWIEAPIERQGRWGFIGKLVPKDSPIYQELVNKLTYSSNNDYKAPQNPITYRNC

SEQ ID NO: 2954 - protein, 63 aa, H. influenzae strain 86-028NP
MMKKFPNFKPHSDTETEELISLLFRKLDIDELIFLLRVLQRDIRAKYTLTKIIKKNINLKLDS

SEQ ID NO: 2955 - protein, 50 aa, H. influenzae strain 86-028NP
MKIQDNVGYYFTIQDLQDRLRVSRSTILRLIESKKLTSIKFGRQVRIPES

SEQ ID NO: 2956 - protein, 296 aa, H. influenzae strain 86-028NP
VQLYPKDVALTHKYIQFNDLFIKFMVLDLDRENSAMDWELLGLPSPNIVVQNRLNGRCHYIYALEVPICNTKNARFKPISYFKKIQRAYIDKLGADQHYVGVFTKNPNSNFWRTFVFNVPKYTLDYLADFVDLSNKPVFYLNDNEDIEGRNCSLFNQIKKIGYREVLKFKCSGKQLEQFNQYLLSSLELLNQNHNPPLPYRELKGIARSSSRWIWERFSESSFQQIQSNRSRKRWEKQQIIKKELFNQFGANKPNMSLKQIAEQFSISVSSLNRWSEEFGWVKSQNDLKSKYEKIV

SEQ ID NO: 2957 - protein, 271 aa, H. influenzae strain 86-028NP
MQHKLIAFIGGGNMAQAIILGLLKQGYPAEQIIVNDPNEEKRAFFANLGVATSENNVESAIKAEVVLLAVKPQMMADVCLPLSAVDFSDKLLISIAAGISTERLNALIPSVKSIVRVMPNTPALVGEGMAGLFAPKNTSENYRTFAQDLLGAVGRTVWVDDETQMHAVTAASGSSPAYFFLMLEAMQQALIKMNIDEKTARELVQQSMLGAAKMVTENPQIALSTLRENVTSKGGTTAAALAVFDAQHFNQTIEQAMQACLSRSQEMETLF

SEQ ID NO: 2958 - protein, 388 aa, H. influenzae strain 86-028NP
MQVRPFYWLALSFLGYYCAYGVFLPFFPAWLKSQQYGEEMIGLVIGSAYIFRFAGGLFFSSLIKKANHIIISLRLLALASAIIMAAMSLVAHNFWLLFIAIGLYASVNSAGMPIGDSLASTWQRQIGLDYGKVRLIGSAAFILGVVVFGGMIGWVGEQNIVWILTALLSFYTIIQLLKPTIPPKDEIPEGGVQNDVGFIALLKNPMTLRVMVAVGLIQGSHAAYYVYSTIYWTSIGISVSQTSLLWGIGVLAEIVLFFFSRRLFQNISISVLLYISALACIGRWAVIGYIDDFWLIFLLQLIHSLTYAVCHYAIVRYITTQPQSHIAKLQGLYNGLSNGVLIAIFTAIAGMIYPTSPAMTFVFMSIIAAAAFFVIPRKLNAFLIVQHK

SEQ ID NO: 2959 - protein, 297 aa, H. influenzae strain 86-028NP
MKNLALIDLFLNEYWIEKGLSENTVQSYRLDLTALCDWLDKNDLSLETLDAVDLQGFLGERLEKGYKATSTARMLSAMRKLFQYLYREKYRVDDPSAVLSSPKLPSRLPKYLTEQQVSDLLNTPDVKVPLELRDKAMLELLYATGLRVTELVSLTIENMSVQQGVVRVIGKGNKERIVPMGEEAAYWVRQFMLYGRPVLLNGQSSDVVFPSQRAQQMTRQTFWHRVKHYAILADIDADALSPHVLRHAFATHLVNHGADLRVVQMLLGHTDLSTTQIYTHVAKERLKRLHERFHPRG

SEQ ID NO: 2960 - protein, 95 aa, H. influenzae strain 86-028NP
MKKITLFFTALLCLFSTSVLAEPNSIPKQCEQLFKETENLIAQAEKQPGTHIQVNKIKSKLNQSKQQILQMELATQLKSCEVGLAKLSNLKSYSE

SEQ ID NO: 2961 - protein, 335 aa, H. influenzae strain 86-028NP
MIEADRIISGQAKVDEDVIDRAIRPKLLADYVGQPQVREQMDIFIKAAKLRQDALDHLLIFGPPGLGKTTLANIVANEMGVNIRTTSGPVLEKAGDLAAMLTNLEPHDVLFIDEIHRLSPAIEEVLYPAMEDYQLDIMIGEGPAARSIKLDLPPFTLVGATTRAGSLTSPLRDRFGIVQRLEFYSVEDLTSIVARSADCLNLELEQQAAFEVARRSRGTPRIANRLLRRVRDYADVRNGGIISINVAKQALSMLDVDDAGFDYLDRKLLSAVIERFDGGPVGLDNLAAAIGEERDTIEDVLEPYLIQQGFLQRTPRGRIATSQTYRHFGLQKLSD

SEQ ID NO: 2962 - protein, 204 aa, H. influenzae strain 86-028NP
MIGRLQGILLEKQPPEILLNVQGVGYELLLPMTSFYDLPEIGQETTLFTHLVVREDAHLLFGFAQKTDRTLFRELIKTNGVGPKLALAILSAMSVEQFAYAIEREELSKLTKIPGVGKKTAERLLVELKGKFKGIKQSDFFVESTHIPLSPSIESHSESSSDEAISALIALGYKPAEAEKMVKRVAKPELTSEQVIREALKAAL

SEQ ID NO: 2963 - protein, 190 aa, H. influenzae strain 86-028NP
MSIILGIDPGSRVTGYGVIRQTGRHLEYLGSGAIRTQVEDLPTRLKRIYAGVTEIITQFQPNMFAIEQVFMAKNADSALKLGQARGTAIVAAVNNDLPVFEYAARLVKQTVVGIGSADKVQVQEMVTRILKLSDKPQADAADALAIAITHAHSIQHSLHIANSVKMTETQEKMTALLKTRYSRGRFRLKI

SEQ ID NO: 2964 - protein, 246 aa, H. influenzae strain 86-028NP
MAGHSKWANIKHRKAAQDAQRGKIFTKLIRELVTAAKIGGGDVSANPRLRAAVDKALSNNMTRDTINRAIDRGVGGGDDTNMETKIYEGYGPGGTAVMVECLSDNANRTISQVRPSFTKCGGNLGTEGSVGYLFSKKGLILIAEADEDALTEAAIEAGADDIQPQDDGSFEIYTAWEDLGSVRDGIEAAGFKVQEAEVTMIPSTTVDLDIETAPKLLRLIDMLEDCDDVQNVYHNGEICDEVASQL

SEQ ID NO: 2965 - protein, 157 aa, H. influenzae strain 86-028NP
VRSDLTAFLMMQYKNNQSVLVVIYAKNTNRVLMLQRQDDPDFWQSVTGTIESGETPKKTAIRELWEEVRLEISENSTALFDCNESIEFEIFPHFRYKYAPNITHCKEHLFLCEAEKEFIPVLSEHLAYQWVSPEQAIQMTKSSNNAEAIRKYILKDK

SEQ ID NO: 2966 - protein, 588 aa, H. influenzae strain 86-028NP
MMRTHYCGALNRNNIGQDVTLSGWVHRRRDLGGLIFIDMRDRDGIVQVCFDPKYQDALTAAAGLRNEFCIQIKGEVIARPENQINKNMATGEVEVLAKELRIYNASDVLPLDFNQNNTEEQRLKYRYLDLRRPEMAQRLKTRAKITSFVRRFMDDNGFLDIETPMLTKATPEGARDYLVPSRVHKGKFYALPQSPQLFKQLLMMSGFDRYYQIVKCFRDEDLRADRQPEFTQIDVETSFLTAPEVREIMERMVHDLWLDTIGVDLGKFPVMTWQEAMRRFGSDKPDLRNPLEMVDVADIVKDVEFKVFNEPANNPNGRVAVIRVPNGAEITRKQIDEYTQFVGIYGAKGLAWAKVNDINAGLEGVQSPIAKFLNEEVWKALAERVNAQTGDILFFGADKWQTTTDAMGALRLKLGCDLGLTRLDEWQPLWVIDFPMFERDEEGNLAAMHHPFTSPKDFSPEQLEADPTSAVANAYDMVINGYEVGGGSVRIFDPKMQQTVFRILGIDEEQQREKFGFLLDALKFGTPPHAGLAFGLDRLTMLLTGTENIRDVIAFPKTTAAACLMTEAPSFVNPQALEELAISVVKAE

SEQ ID NO: 2967 - protein, 172 aa, H. influenzae strain 86-028NP
MLFINITFACILAIRFYSLSISIRHEKALIAKGAIQYGKRNSTLLSIAHVAFYFAAIIEANKQNLSFNSTSQIGLAILIFAIAMLFYVIYELKEIWTVKIYILPEHQINRSFLFKYVRHPNYFLNIIPELIGLSLFCQAKYTALVGLPIYLLILAVRIKQEESAMSHLFPKS

SEQ ID NO: 2968 - protein, 241 aa, H. influenzae strain 86-028NP
MVKDTLFSTPIAKLGDFIFDENVAEVFPDMIQRSVPGYSNIITAIGMLAERFVTADSNVYDLGCSRGAATLSARRNIHQPNVKIIGIDNSQPMVERCRQHIAAYHSEVPVEILCDDIRHVEIKNASMVILNFTLQFLPPEDRVALLTKIYEGLNPNGVLVLSEKFRFEDTKIDHLLIDLHHQFKRANGYSELEVSQKRTALENVMRTDSIETHKVRLKNVGFSQVELWFQCFNFGSMIAVK

SEQ ID NO: 2969 - protein, 78 aa, H. influenzae strain 86-028NP
MLTKVFQSGNSQAVRIPMDFRFDVDTVEIFRKENGDVVLRPVSKKTDDFLALFEGFDETFIQALEARDDLPPQERENL

SEQ ID NO: 2970 - protein, 134 aa, H. influenzae strain 86-028NP
MIYMLDTNIIIYLMKNRPKIIAERVSQLLPNDRLVMSFITYAELIKGAFGSQNYEQSIRAIELLTERVNVLYPNEQICLHYGKWANTLKKQGRPIGNNDLWIACHALSLNAVLITHNVKEFQRITDLQWQDWTK

SEQ ID NO: 2971 - protein, 135 aa, H. influenzae strain 86-028NP
MQILHTMLRVGDLDRSIKFYQDVLGMRLLRTSENPEYKYTLAFLGYEDGESAAEIELTYNWGVDKYEHGTAYGHIAIGVDDIYATCEAVRASGGNVTREAGPVKGGSTVIAFVEDPDGYKIEFIENKSTKSGLGN

SEQ ID NO: 2972 - protein, 229 aa, H. influenzae strain 86-028NP
MSDSQEIPYHNQLKNRFRGYFPVIIDVETAGFDAKKDALLELAAITLKMDENGYLHPDQKCHFHIKPFEGANINPESLKFNGIDIHNPLRGAVSELDAITGLFQMVRRGQKDADCQRSIIVAHNATFDQSFVMAAAERTGVKRNPFHPFGMFDTASLAGLMFGQTVLVKACQAAKIPFDGKQAHSALYDTERTAKLFCYMVNHLKDLGGFPHIASELEQEKTTEKETAL

SEQ ID NO: 2973 - protein, 450 aa, H. influenzae strain 86-028NP
MLSNPVVISIIVLLALSLLRINVIIALVIAALTAGFIGDLGLTKTIETFTGGLGGGAEVAMNYAILGAFAIAISKSGITDLIAYKIITKMNKTPTAGNLTWFKYFIFAVLALFAISSQNLLPVHIAFIPIVVPPLLSIFNRLKIDRRAVACVLTFGLTATYILLPVGFGKIFIESILVKNINQAGATLGLQTNVAQVSLAMLLPVIGMILGLLTAIFITYRKPREYNINVEEATTKDIEAHIANIKPKQIVASLIAIVATFATQLVTSSTIIGGLIGLIIFVLCGIFKLKESNDIFQQGLRLMAMIGFVMIAASGFANVINATTGVTDLVQSLSSGVVQSKGIAALLMLVVGLLITMGIGSSFSTVPIITSIYVPLCLSFGFSPLATISIVGVAAALGDAGSPASDSTLGPTSGLNMDGKHDHIWDSVVPTFIHYNIPLLVFGWIAAMYL

SEQ ID NO: 2974 - protein, 195 aa, H. influenzae strain 86-028NP
MTVQQLIQRLDQKVQQLYQAHLSKREEKIFAKFDRTLFSENGQNVSFYLKEINQTLDRIKTLESNDSNHYNFLAERLLAQCSVLSEALVRKNTHLTESQTTTKQTIQKSQHSIHKLPPRERLEKYYEAREQLNNLYRQHKDLAQAEKNNDEKIRYAQLAEVYKKRQQKCQDAIDLLEEYLVFKEEVENRENTENK

SEQ ID NO: 2975 - protein, 188 aa, H. influenzae strain 86-028NP
MATYTTSDFKPGLKFMQDGEPCVIVENEFVKPGKGQAFTRTRIRKLISGKVLDVNFKSGTSVEAADVMDLNLTYSYKDDAFWYFMHPETFEQYSADAKAVGDAEKWLLDQADCIVTLWNGAPITVTPPNFVELEIVDTDPGLKGDTAGTGGKPATLSTGAVVKVPLFVQIGEVIRVDTRSGEYVSRVK

SEQ ID NO: 2976 - protein, 338 aa, H. influenzae strain 86-028NP
VRILPQEPVIREEQNWLTILKNAISDPKLLLKALNLPEDDFEQSIAARKLFSLRVPQPFIDKIEKGNPQDPLFLQVMCSDLEFVQAEGFSTDPLEEKNANAVPNILHKYRNRLLFMAKGGCAVNCRYCFRRHFPYDENPGNKKSWQLALDYIAAHSEIEEVIFSGGDPLMAKDHELAWLIKHLENIPHLQRLRIHTRLPVVIPQRITDEFCTLLAETRLQTVMVTHINHPNEIDQIFAHAMQKLNAVNVTLLNQSVLLKGVNDDAQILKILSDKLFQTGILPYYLHLLDKVQGASHFLISDIEAMQIYKTLQSLTSGYLVPKLAREIAGEPNKTLYAE

SEQ ID NO: 2977 - protein, 431 aa, H. influenzae strain 86-028NP
VNSMDKNQQSSQNELDLGLNQEPITPKKTIQPSSSILGKAKGLFAKKNHVQTNFQQRKEPTFGDSSTQENDPLIPSENLKKVQKPVLQTSSTEENISAVDEEISAENNADEPVEKAEKPILAQPEKWKILQVLPAKHRRLFMAIFVLVILLIIFFALKPSSDTVESFTQSNSNEVPVQFQSLDQSQPLETTILDNPPAQNQMAVEQANQSEFAPKAEEAANNTTAQNPLVENAPMQQNVVQSPSQMPNEMAAASVMPMQPAQAEQPKATVPVQPMKKAVEPQVAHKDTVKKEVKVAENAQAPSKATEQNVAKTAGNAPIVEAKPVQVKKEKKVQIVDAKPVSKSAASRLSAKTLTVPKGVSLMQVFRDNQLNISDVNAMSKAAGAGNVLSSFKSGDKVTVSVNNQGRVNEMRLSNGARFVRQSDGSYQYKK

SEQ ID NO: 2978 - protein, 134 aa, H. influenzae strain 86-028NP
MLKKTSLIFTALLLAGCAQNANVTTPQTQKMQVEKVDKALQKGEADRYLCQDDKVVRVVHATHKKYKKNLHYVTVTFQGVSEKLTLMISERGKNYANIRWMWQERDDFSTLKTNLGEILATQCVSQTSERLSGQ

SEQ ID NO: 2979 - protein, 236 aa, H. influenzae strain 86-028NP
VQSELQRGFVLHRRPYSETSLLVDLFTEESGRLTVIAKGARAKRSSWKSVLQPFTPLLLRWTGKSTLKTLTKAEPAAITLPLQQIALYSGFYVNELLTRVIESETPNPALFQHYLKCLTGLATETNVEPTLRLFEFQLLQMLGYGVDFLHCAGSGEPVDFSMTYRYREEKGFVASLVKDNLTFYGRDLLAFEALDFSDDAVRQAAKRFTRIALKPYLGDKPLKSRELFTQNILLLK

SEQ ID NO: 2980 - protein, 438 aa, H. influenzae strain 86-028NP
MVLLYTPKQKTNNVQTITADILDLDYQGLGVAKINGKTWFIENALPHEKVECRILEDKRQYGHATAKKWRVKSSERLEPKCAHFMRCGGCQGQHIPIEMQRKAKQSALFKRLSKLQSEPISFQPMICGDAWAYRRRVRLSLWFNPNTKQIDMGFRQKNTNDLIPVQSCEVAEPAINYLLPKLTALLEKFSTPKQLGHIELVAADNGVAMLLRYTKNLAEIDRTLLLKFAEQEKLMLFLQSDKGIEQIYGDAPYYQFSDGIKLHFDIRDFIQVNSALNERMINTALDWLELSQQDCVLDLFCGMGNFTLPLAKRVKSAVGIEGVFEMVQKAAQNAARNQIKNIEFFQADLDQSFVEQPWANQSFNKILLDPPRSGAAFALNALCELKAEKILYVSCNPATLVRDAEILCDFGYKIEKSAVIDMFPHTGHLESITLFTTK

SEQ ID NO: 2981 - protein, 743 aa, H. influenzae strain 86-028NP
MVAVRGSHLLNPQNFVIEQWCTGLKLAEQTEKSLIDAWYYARDLMNAYPDEMKNATLMLQSGVEMVEILHELNMDAETLLTAMLFPIVANKLTDWESLKEKFGAKITKLLKGVLEMDNIRQLNASHSANALQVDNVRRMLLAMVDDFRCVIIKLAERITFLRDAEYRCAEEDKVLAVKECSYIYAPLANRLGIGQLKWELEDYCFRYLHPEQYRAIAKLLQERRLDREHYIADFVSELSSYLRENIKQVEVYGRPKHIYSIWRKMQKKNLEFSGLYDVRAVRIIVQKLQDCYTALGIVHTQFKHLPKEFDDYVANPKPNGYQSIHTVVLGKGGKPIEVQIRTQQMHDDAELGMAAHWKYKEGNTGSMSAYEEKIAWLRKLLAWQDDITDSGEVLAELRSQVFDDRVYVFTPKGEVVDLPTGSTPLDFAYAIHSEIGHRCIGAKVAGRIVPFTYQLQMGDQIDIITQKNPNPSRDWLNPNLGFTHTAKSRAKIQAWFKKQDRDKNIPAGKELLDNELALLNLSIKQVEPYALPRYNLKNLDDLYAGIGSGDIRLNNLINFLQSKLIKVTAEEADQEILRHVANKSAVNSQQKSEKNNGYVIVEGVDNLMHHIARCCQPIPGDAIVGYITMGRGISIHRADCEQFLDLQAAHPERVVESIWGENYASGFHINIRIVAGDRNGLLRDITTVLANEKISVLGVSSRADTKKQLATIDMEIELHNVESLSKILARLAKLDDVIEAKRL

SEQ ID NO: 2982 - protein, 118 aa, H. influenzae strain 86-028NP
MYKTTGLTHLINSTKYSLQGLKSAFKNETAFRHECFLACILIPLTFFLGETKIEIILMISSVLLVMALELLNSAVEAVVDRIGTERHELSGRAKDQGSASVFIALCIVGIVWGGILFF

SEQ ID NO: 2983 - protein, 197 aa, H. influenzae strain 86-028NP
MTALLKIGLVSVSDRASAGVYQDQGIPELQAWLEQALVDPFHLETRLIPDEQPIIEQTLKELVDEQGCHLVLTTGGTGPAKRDVTPDATLAVADREMPGFGEQMRQVSLHFVPTAILSRQVGVIRKESLILNLPGQPKAIKETLEGVKDKEGNVLVKGIFSAVPYCLQLINGLYIDTKPEIIESFRPKSARRENLEK

SEQ ID NO: 2984 - protein, 112 aa, H. influenzae strain 86-028NP
MKKIEAMIKPFKLDDVRESLSDIGISGMTITEVRGFGRQKGHTELYRGAEYMVDFLPKVKLEVVVPDELVDQCIEAIVETAQTGKIGDGKIFVYHVERAIRIRTGEENEDAI

SEQ ID NO: 2985 - protein, 348 aa, H. influenzae strain 86-028NP
VQNNLNLHRTLLGIAAVIIILAGVKLAAEIVVPFLLSLFIAIICSPIIKAMTQRRVPHWLAITLLFVLISLVFFFLVGLINSTAREFTQSIPQYKVLLSQRVSDLTGLLQRFNLPFTLSRETIQENFDPSIIMNFVSRVLLNFSGVVSNVFVLVLVVIFMLAEAPTMKHKFAMVISSTPHDAAKEERHIDRVLQGVIGYLGIKSITSLLTGVGVFILLEACGVQYAILWATLSFLLNYIPNIGSIIAAIPIIVQALLLNGFGIGFGVAIGVIAINMVVGNIIEPKMMGQRLGLSTLVVFLSLLFWGWLLGTVGMLLSVPLTMALKIALESSPNTAKYACLLGDVEDFK

SEQ ID NO: 2986 - protein, 730 aa, H. influenzae strain 86-028NP
MKIVRVALAVPLPRLFDYFVPDDVSLQIGMRVLVPFGTQKRVAIVADFPTKSDVPEDKLKAILQPLDLAPLFTPIYWDWLHWAANYYQAGLGDVLFQALPVKLRNGESAVKNDRTFWRITDAGKNALEQGELKRSKKQAEALQCLSETDLEKGNNNFSSAIWSALKAKGFIEEITIQTNPLSWQQRLGNNPIVNAENRLTLNKQQALAFSQLLFHSGFNVWLLDGVTGSGKTEIYLQYIEEILKSGKQVLVLVPEIGLTPQTVQRFKARFNVEIDVLHSNLTDTQRLYVWDRARSGQSAIVIGTRSALFTQFSNLGAIILDEEHDSSYKQQDSWRYHARDLAIVLAQKLNIAVLMGSATPSLESINNVQNGKYQHLVLSKRAGNSTALRHFVIDLKNQNIQNGLSKPLLERMKAHLEKGNQVLLFLNRRGFAPVLLCHECGWIAQCPHCEKPYTYHQHQNVLRCHYCGAQKTIPRQCGDCGSTHLVTTGLGTEQLEETLKTLFPHYSVARIDRDSTARKGKLEGYLEDIQQGKSQILIGTQMLAKGHHFPNVTLVALVNVDSALFSLDFRAEERLAQLYIQVAGRAGRADKQGEVVLQTHYPDHPLLTTLLANGYQAFAKETLQLRHSMGLPPFTFQALFKAQARHSDLAENCLSQIADFFQSKQITGLQMLGPMPAPFSKKAGQYRWQLLLQHPSRMTLQKALREYQQAELEKNSLVRLILDVDPQDLS

SEQ ID NO: 2987 - protein, 246 aa, H. influenzae strain 86-028NP
MTQTFADQKRKTVETAEFTEDGRYKRKVRSFVLRTGRLSEFQRNMMNDNWGTLGLDYQTEPFDFAKIYGNDNPIVLEIGFGMGKSLVDMAFANPDKNYLGIEVHTPGVGACIAYAVEKGVTNLRVICHDATEILRDSIADGALGGLQLFFPDPWHKAKHHKRRIVQPHFVTQVIQKLGKNGFIHMATDWENYAEQMLEVLSANTDLVNTSKNGDYIPRPDFRPLTKFEARGYKLGHGVWDLYFVKK

SEQ ID NO: 2988 - protein, 114 aa, H. influenzae strain 86-028NP
MSKSYNQRQRKKLHLAEFQELGFLVNFQFAEGTAIETVDEIVDRFINEVIQPNGLAYEGSGYLHWEGLVCLEKIGKCDESHRETVKKWLETNGLQQIEVSELFDIWWEYPAKAE

SEQ ID NO: 2989 - protein, 176 aa, H. influenzae strain 86-028NP
MTVENLPRRQFLRGKFSTLSCLENNQKQNFVGIRPPWSVENSIFVAQCTRCGDCLSVCETNILVKDDAGFPEVRFDNGECTFCGKCVDACKQPIFYPRDQLPWSHKIDIGVACLTLHRIECRTCQDNCPANAIRFKLQMGGVAQPLVNFDACNGCGACVQGCPVNAITMNDLKQNE

SEQ ID NO: 2990 - protein, 93 aa, H. influenzae strain 86-028NP
MNNTNLILENARDWHVVGLIVQGNPKKLSAIQTALLAIEHTEIPTFDEKLGKFVVVMQSNDQHLLLEKMESVKDIDGVINVSLVYHEQDEQNK

SEQ ID NO: 2991 - protein, 832 aa, H. influenzae strain 86-028NP
VGENAMNLSRRDFMKANAAMAAATAAGLTIPVKNVVAAESEIKWDKAVCRFCGTGCAVLVGTKDGRVVASQGDPDAEVNRGLNCIKGYFLPKIMYGKDRLTQPLLRMTNGKFDKNGDFAPVSWDFAFKTMAEKFKEAFKKNGQNAVGMFSSGQSTIWEGYAKNKLWKAGFRSNNVDPNARHCMASAAVAFMRTFGMDEPMGCYDDIEQADAFVLWGSNMAEMHPILWSRITDRRISNPDVRVTVLSTYEHRSFELADHGLIFTPQTDLAIMNYIINYLIQNNAINWDFVNKHTKFKRGETNIGYGLRPEHPLEKDTNRATAGKMHDSSFEELKQLVSEYTVEKVSKMSGLDKVQLETLAKLYADPTKKVVSYWTMGFNQHTRGVWVNQLIYNIHLLTGKISIPGCGPFSLTGQPSACGTAREVGSFPHRLPADLVVTNPKHRETAERIWKLPKGTVSEKVGLHTIAQDRAMNDGEMNVLWQMCNNNMQAGPNINQERLPGWRKEGNFVIVSDPYPTVSALSADLILPTAMWVEKEGAYGNAERRTQFWRQQVKAPGEAKSDLWQLMEFAKYFTTDEMWTEDLLTQMPEYRGKTLYEVLFKNGQVDKFPLSELAEGQLNDESEYFGYYVHKGLFEEYAEFGRGHGHDLAPFDMYHKAHGLRWPVVEGKETLWRYREGYDPYVKEGEGVAFYGYPDKKAIILAVPYEPPAESPDNEYDLWLSTGRVLEHWHTGTMTRRVPELHRAFPNNLVWMHPLDAQARGLRHGDKIKISSRRGEMISYLDTRGRNKPPRGLVFTTFFDAGQLANSLTLDATDPISKETDFKKCAVKVEKAA

SEQ ID NO: 2992 - protein, 279 aa, H. influenzae strain 86-028NP
MKVRLKSKKKMKKPALNPERRKFLKEATRTAGGLAGVGILLGLQQNQSLAREGVPLRPPFALQDAKAFSAACIRCGQCVQACPYDMLHLASLLSPVEAGTPYFIARDKPCEMCPDIPCAKACPSGALDRQATDINESRMGLSVLLDHETCLNYQGLRCDVCYRVCPLIDKAITLETQHNPRSDKHALFIPTVHSDACTGCGKCEQACVLEEAAIKILPMDLAKGMLGKHYRLGWEEKAKAGHSLAPKDMISLPTRTPEGTTVIPEPAEPVLAPILGGGK

SEQ ID NO: 2993 - protein, 287 aa, H. influenzae strain 86-028NP
MANAPKFAGKEAREKWGWWYANRFLFWRRLSQLSILAMFLSGPYFGVWILKGNYSGSLLLDTIPLSDPLITAESLAARHLPDALTLIGAAIIVLFYAVLGSKVFCGWVCPLNVVTDCAAWLRRKLGIRQTAKISRGLRYGILVLILLGSSVSGMLLWEWVNPVAALGRAFVFGFGATGWLLLVIFLFDLLIAEHGWCGHLCPIGAAYGVIGAKSLIRIKVIDRAKCDNCMDCYNVCPEAQVLRSPLHGKKDESLLVLSKDCISCGRCIDVCAEKVFKFSTRFDHSGE

SEQ ID NO: 2994 - protein, 150 aa, H. influenzae strain 86-028NP
VINMTKQVSKILAGLFTALFAGSLMASDAPAVGKDLTQAAENIPPAFHNAPRQGELPALNYVNQPPMVPHSVANYQVTKNVNQCLNCHSPENSRLSGATRISPTHFMDRDGKVGSSSSPRRYFCLQCHVSQANVDPIVPNDFKPMKGYGN

SEQ ID NO: 2995 - protein, 200 aa, H. influenzae strain 86-028NP
MSEKKPNILKRFWQWFRKPSRMAIGTIIILSAIGGILSWVGFNYGLEKTNTEQFCASCHMQDAYPEYLHSVHYQTRTGVGASCPDCHVPHEFGAKMKRKIIAAKEVYAHYTGKVDTLEKFNAHRLEMAQNEWARMKANDSKECRNCHNVDRMNFNDQRSVAARMHQKMKTEGKTCIDCHKGIAHQLPDMSGVESGFKDEK

SEQ ID NO: 2996 - protein, 214 aa, H. influenzae strain 86-028NP
MKIILLGAPGAGKGTQAQFIMNKFGIPQISTGDMFRAAIKAGTELGKQAKALMDEGKLVPDELTVALVKDRIAQADCTNGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQYFRLDGTQKVEEVSQELDKILG

SEQ ID NO: 2997 - protein, 425 aa, H. influenzae strain 86-028NP
MSNSLSSQIFTRKMLICAFTGFNSGLPLFVLSQMLPVWLTDKHLSIELIGAVTGVMLPYGLKFLWAPLLDRYFPSFLGRRRSWMLLSQVALLILLYIISLFDPLTQLGTVANIALLIAFFSATQDIVLDAYRREILSDHELGLGNTIHINAYRIAGLIPGGLSLYLAAIYPWETVFLWTALCMLAGIFMTLFLAKEPKINVQQTNQPFYQAFWIPLQEFFQRKGVIQAIGFLLFLFLYKFGDSFATTLQTKFIYDMGFSKEDIAIVVKSNALWSSILSGLAGGMIMLKLGINRALWLFGLVQMVTIGGFIWLSAFGHFDVITSAELWKLGVVIAAEYIGVGLGTAAFVAFMARESNPLYTATQLALFTSLSALPSKVLGILSGYVVGAVGYYQYFWFCLFLAIPGMLCLFWVAPLKQENNKTSSV

SEQ ID NO: 2998 - protein, 338 aa, H. influenzae strain 86-028NP
MAILVTGGAGYIGSHTVVELLNAGKEVVVLDNLCNSSPKSLERVKQITGKEAKFYEGDILDRALLQKIFAENEINSVIHFAGLKAVGESVQKPTEYYMNNVAGTLVLIQEMKKAGVWNFVFSSSATVYGDPKIIPITEDCEVGGTTNPYGTSKYMVEQILCDTAKAEPKFSMTILRYFNPVGAHESGLIGEDPNGIPNNLLPYISQVAIGKLAQLSVFGSDYDTHDGTGVRDYIHVVDLAVGHLKALQRHENDAGLHIYNLGTGHGYSVLDMVKAFEKANNITIAYKLVERRAGDIATCYSDPSLAAKELGWVAERGLEKMMQDTWNWQKNNPKGYRD

SEQ ID NO: 2999 - protein, 320 aa, H. influenzae strain 86-028NP
MSINQSINQSINQSINQSINQSINQSKSVIIAGNGTSLKSIDYSLLPKDYDVFRCNQFYFEDHYFLGKKIKKVFFNCSVIFEQYYTFMQLIKNNEYKYEYADIILASFLNLGDSTLKKIQHLEKLLPQIDLGHCYLKKLRAFNAHLQYHELYENKRITSGVYMCAVATAMGYKDLYLTGIDFYQEKGNPYAFHHQKENIIKLLPSFSQNKSQSDIHSMEYDLNALYFLQKHYGVNIYCISPESPLCNYFPLSPLNNPIAFIPEEKKNYTQDILIPPKFVYKKIGIYSKPRIYQNLIFRLFWDILRLPNDIKHALKSRKWD

SEQ ID NO: 3000 - protein, 240 aa, H. influenzae strain 86-028NP
MVRIQDLSLAFNGQTLFEHLNLTLLPNEWVSLLGSSGVGKSTLLRLLAGIETQGVVQGKILFEPKIRIAWLPQKETLYPWLSIVDNVQLQAVLFGRKSAKTTEKAKMLLEKVGMAAHWHKPCSQLSGGQKQRVALARTLMQEADLILLDEPFSALDAISRHQLQDLAFELLEDKSVLLVTHDPQEALRLSQRIFVLRSPESHQTALSAVILPEGNAPRELHQANLWALQQQLLQELGGEQ

SEQ ID NO: 3001 - protein, 245 aa, H. influenzae strain 86-028NP
MKIRLLKPLLIVGVLLMIWQMVATLGSFPHYIFPSPQAVGQQLFTHAELLWQHTQVTLLEICLGLLLGFLFGLISALLLSFSRQISAVLLPILVISQAIPVFAIAPLLVLWFGYGMASKIVMSVLIIYFPVTAACYDGLRNTPQAWLDLAKTFNISPLRLLLKVRLPAALPAFASGLRIAVSVAPIGAVVGEWVGSSEGLGYLMIHANARMQVDLMFAALLILVSISLCLYFSIDWLLHRFIWSV

SEQ ID NO: 3002 - protein, 314 aa, H. influenzae strain 86-028NP
MKTIIRYFSFVMGLMLTLPSFAKEKISVMLDWYVNPDHAAIIVAQQKGFFEKNNLEVEIIEPADPALPPKLAAAGKVDLAVSYQPQLYQQVAEGLPLVRVGSLISNPLNSVVVLKKSNLETLADLKGKKVGYSVSGFEDGLLDTMLHSIGLSNKDVELVNVNWSLSPSLLTGQVDAVIGAFRNFELNQLALEKQEGVAFFPEQYGVPAYDELILVANKNSVTDKKTSAFLTALEQATSYLQAHPNEAWQAFVSYKPNELNTPLNQLAWKDTLPFLANKPRQLDAKRYQQMAEFMQQKGLIPKALALKEYAVEIE

SEQ ID NO: 3003 - protein, 215 aa, H. influenzae strain 86-028NP
MIEQLIQQAQPYWQQYIEHEFVQQLAKGTLPKACFQHYLKQDYLYLFHYSRAFALGVYKAKNFAEMEIPRKTLEILCQEIQLHLNYCREWGISEQEIFATQESPACIAYTRYLLDCGMTGSLAELYAAVTPCALGYAQVARYITQHYPRLPNNPYQTWIDTYASEEFQQAAQETVDFLTALCKPLNSSQLTEIQQIFTTATRMEIAFWQMGLDLA

SEQ ID NO: 3004 - protein, 271 aa, H. influenzae strain 86-028NP
MFDWLLEPLQFEFMQNALLTALIVSIICALLSCYLVLKGWSLMGDAISHAVLPGIVLAYLAGIPLAIGAFFSGIFCSLGVGYLKENSRIKEDTAMGIVFSGMFAIGLVMFTKIQTEQHLTHILFGNVLGVSHQELIQSAVISAIIFCLIVFKRKDFLLYCFDPSHARVAGLSPKVLHYGLLILLALTIVSTMQVVGVILVVAMLIAPGITALTLTKSFDKMLWVAIASSIASSLIGVILSYHFDASTGACIILLQAAFFVIALAYSKIRTR

SEQ ID NO: 3005 - protein, 282 aa, H. influenzae strain 86-028NP
MLDLLLEPFSYDYMLKAMILSTAVGGICAFLSSYLMLKGWSLIGDALSHSVVPGVAIAYAFALPYALGAFFAGILAALSILWIKSISKLKEDAVIGFIFSTFFALGLLIVSLNPTAVNVQNIILGNILGIADDDIYQVAIIIGVCLVLLLLFWKDLLLIFFDETQARTVGLSPLFYKVLFFTLLSACVVAALQTVGAILVIAMVITPGATAYLLTDKFKTLSIIAIILGAVTSFVGVYISYYLDGATGGVIVTLQTLLFLVAFLFSPKYGLLTRNKKAVENV

SEQ ID NO: 3006 - protein, 306 aa, H. influenzae strain 86-028NP
MDSFSTSIWVNDVTVRYNNGHTAIHNMTFSLNSGTICALVGVNGSGKSTLFKSIMGLVKPQQGEIKLCDLPISQALKRNLVAYVPQSEEVDWQFPVSVYDVVMMGRYGYMNFLRIPKAIDKQKVQEAMQRVNIEHLAHRQIGELSGGQKKRVFLARALAQQSPIILLDEPFTGVDVKTENAIVDLLQQLREEGHLILVSTHNLGSVPDFCDQVVMINRTVIAAGKTENTFNQHNLEIVFGGVLRHIKLLGENLHNDEDKRSVTVLTDDEKAVVFYGETKQDPPAPTTQNCHFEDCPYKSAVKNKRD

SEQ ID NO: 3007 - protein, 293 aa, H. influenzae strain 86-028NP
MRNSFKIMTALALGLFAMQANAKFKVVTTFTVIQDIAQNVAGNAATVESITKPGAEIHEYEPTPKDIVKAQSADLILWNGLNLERWFERFFQNVKDKPAVVVTEGIQPLSIYEGPYKDAPNPHAWMSPSNALIYIENIKNALVKYDPQNAAVYEKNAADYAQKIKQLDEPLRAKLAQIPEAQRWLVTSEGAFSYLAKDYNLKEGYLWPINAEQQGTPQQVRKVIDLVRKNNIPVVFSESTISAKPAQQVAKESGAKYGGVLYVDSLSAKNGPVPTYIDLLNVTVSTIVKGFGK

SEQ ID NO: 3008 - protein, 154 aa, H. influenzae strain 86-028NP
MKKAFWLVLSSAIVLAACDDKPKMTEQTKTTDQAKMAAEQPDQKPVLINYKQIALDKSQQAIDTAKVAQDKSVQANEAVKVAMQKQQEAEIALSQGGEEAEKLSKQKMDESNAAAELALKLSEESKAASALSIQLSKEAEDAANKANQQAQAEK

SEQ ID NO: 3009 - protein, 292 aa, H. influenzae strain 86-028NP
MFKKALFILSLCPSFLLAQSYVVYDFTHNRVLESYAPDSIQPIASVTKLMTANVFLENNKNPNCRIAITKEDTDRIKGTGTKLPKNIPISCNELLKAMLVHSDNYAAHALSRAAGISRRQFINKMNEKAHQLGMYSTRFHDSSGLSSYNISSPMDLVKLAKYSLNKSDIKLLSNLSATYIQAGKHKLYIKNTNKLVRDEIFDAAVNKTGYIRESGYNLVFINKHLCKNATIGVISLNNTSSAYRSSFTKSKLEKFGCTALNGRTIRDVAGEAQYEDGYDEVGFNTLIQKLSR

SEQ ID NO: 3010 - protein, 390 aa, H. influenzae strain 86-028NP
MCNNEAKMSELLSVQSDAPAKKINLMDLTRQQMREFFKELGEKPFRADQLVKWIYHFGEDNFDNMTNINKKLREKLKAVAEIKAPEVAVEQRSADGTIKWAMQVGEQQVETVYIPEADRATLCVSSQVGCALACTFCSTAQQGFNRNLTVSEIIGQVWRASKIIGNFGVTGVRPITNVVMMGMGEPLLNVANVVPAMEIMLDDFAYGLSKRRVTLSTSGVVPALDNLSKMIDVALAISLHAPNDELRDEIVPINKKYNIKTLIDSVNRYLNVSNANHGKVTIEYVMLDHVNDGIEHAHQLAEVLKNTPCKINLIPWNPFPEAPYAKSSNTRIDRFQKTLMEYGFTVIIRKTRGDDIDAACGQLAGDVIDRTKRTAMKRQFGQNIGVTEVN

SEQ ID NO: 3011 - protein, 179 aa, H. influenzae strain 86-028NP
MQTISKQLSAVIFPFIFSACVSQSASSLDHQAAAKARVELALSYLQQNNPQLAKINLDKALQHDKNYYLVHSALAHYYQQQGQIENAFREYEIAVKLNHKQGDVHNNFGTFLCSQKKFEQAQQQFELALNSPNYYHQADTFENIALCAYSAKKMDIYQQTLEKLRQINGKRAEKFNSLK

SEQ ID NO: 3012 - protein, 303 aa, H. influenzae strain 86-028NP
MNPTTEQVLSPGEIFRQTREALNLSLEDVAKEITLRPSILEQLENNEFIQKSTPSIFVKGYVRSYAKFLRLPDSVWENIVFAETEKNDLGKNARSTRAVNQYSSHNRWIGRLTAIVFVMVIGMTGLWWWQSYQQNTQERDDLVQSYVASTENNQPTTALVTTEETNKSAPETAAPVSQPVEITNNLLPEIAQENSVSQPKNDEKSVSDIQSAVENPSISPTLPIAKGDLVIEILANSSWISVKDNARHVLAQKEYKQGEILTFNGNEFSLIVGAPSNVRITYKGENYPLKVDGRVAKFKLSQP

SEQ ID NO: 3013 - protein, 368 aa, H. influenzae strain 86-028NP
MSAFQPTIKRRESTKIYVGNVPIGGDAPIAVQSMTNTRTTDVEATVAQIKSLERVGADIVRVSVPTMDAAEAFKQIKQQVNVPLVADIHFDYRIALKVAEYGVDCLRINPGNIGREDRVRAVVDCAQDKNIPIRIGVNAGSLEKDLQEKYGEPTPEALLESALRHVEILDRLNFDQFKVSVKASDVFLAVESYRLLAKAIKQPLHLGITEAGGARAGAVKSAVGLGMLLAEGIGDTLRISLAADPIEEIKVGFDILKSLRIRSRGINFIACPTCSRQEFDVIGTVNALEQRLEDIITPMDVSIIGCVVNGPGEALISDLGVTGGNKKSGYYLDGERQKERFDNEDIVNQLEAKIRAKVARQDPKNRII

SEQ ID NO: 3014 - protein, 423 aa, H. influenzae strain 86-028NP
VAKTIQAIRGMNDCAPTESPLWQWIEAQVRNVLNSYGYSEVRMPIVESTPLFARAIGEVTDVVSKEMYTFWDNDEQLTLRPEGTAGCVRAAIEHGWIYNNEQRLWYIGPMFRHERPQKGRYRQFHQVGVEVFGIANPEIDAELIMLTYRLWKALGIDQHVTLQLNSIGSLEARANYRSALVGFLENHQDLMSDEEKERLVRNPLRILDTKNPELQKVLDNAPKLLDYLDDESRAHFEQLCSLLDAVGIQYEINPKLVRGLDYYNKTVFEWVTSALGAQGTVCGGGRYDGLVEQLGGHATPSIGFAMGLERLVLLVQEVNPNVPTKSAVDIYVVYQGEGATLVAFELAEKVRSELPHLNTMLHCSGGNFKKQFKRADKSGATLALVIGESEVQNKQVVVKHLQGGTDQQTLDLVNIIDYLQTQF

SEQ ID NO: 3015 - protein, 204 aa, H. influenzae strain 86-028NP
MAYSIEEEQEINQLKDWWKENGKTIIVAFILGVGGMFGWRYWQSHQAEQIAQASAQYDTLINSVQQDEQAKKANIEQFVQANSKTAYAVFALLDEAKKATQKQDFSAAEANLNQALTQSQDEVLTSIVALRLSAVQFQLGQLDNALTTLNQVKGESFNARKAILTGDIQVAKGDKVAAKNSFEQAQQSGSQLEQQMAKMKLNNL

SEQ ID NO: 3016 - protein, 64 aa, H. influenzae strain 86-028NP
MKWTDAQLIAEELYDRNPDLDPKTVRFTDLHKWICELEDFDDDPNKSNESILEAILLKWLDEFE

SEQ ID NO: 3017 - protein, 113 aa, H. influenzae strain 86-028NP
MPKVIFLPNEDFCPEGMVVDAATGDNLLEVAHNAGVEIHHACDGSCACTTCHVIVREGFDSLNETSDQEEDMLDKAWGLEMDSRLSCQCVVGNEDLVVEIPKYNLNHANEAAH

SEQ ID NO: 3018 - protein, 619 aa, H. influenzae strain 86-028NP
MALLQIAEPGQAAAPHQHRLAVGIDLGTTNSLVASVRSGQSVILNDEQERSLVPSVVHYGVEEKKVGLEAFEQASLDPKNTVISVKRLIGRSLPDVQSRYSSLPYEFVASENGLPLIITAQGPKSPIEVSSDILSRLNHIAEQRLGGELSGVVITVPAYFDDAQRQSTKDAARLAGLNVLRLLNEPTAAALAYGLDSGQEGIIAVYDLGGGTFDISILRLSKGIFEVLATGGDTALGGDDFDHLIADWVIEQTKLKPQTANQQRELITLANQAKITLTNEKSAVISWQDFSVEISREQFNELIYPLVKRSLLTCRRALKDANVESEEVQAVVMVGGSTRVPYVREQVGEFFGKTPLTSIDPDKVVALGAAIQADILVGNKTDSDMLLLDVVPLSLGIETMGGLVEKIIPRNTTIPVARAQEFTTFKDGQTAMSVHVLQGERELVDDCRSLGRFTLRGIPPMAAGAAHIRVTYQVDADGLLSVTAMEKSTKVQASIQIKPSYGLTDEEVTAMIKSSFDNAQEDLQARELAEQRVEADRVIESVIVALQADGAELLSTDEFHHIETVLKQLMDVKQGSDRDAIAQGIKALDTATQEFAARRMNASINKALTGKNLSDIENP

SEQ ID NO: 3019 - protein, 228 aa, H. influenzae strain 86-028NP
MQTLEQLTSPEHSAWITLSQWIDNARNHCEVIKKDQSSAERELFTMQMPTSSPMGAVIYETGGILIHYGWLRILGSGSFKLPRGLMDWNFSKSFSESGEKPKYLLVADDVIGGYFALNGGSLGNNIGKIYYYSSKDLTWHNLNFTYTEFLAWALNGDVEAFYQGLFWKNWQDDVKQLDGNQVFVFTPDLNQDRKIAIDERQKQEVNIETHYQANFAEKNKFDLAYSVA

SEQ ID NO: 3020 - protein, 174 aa, H. influenzae strain 86-028NP
MFNPFQIFDLPVDFQLDEKVLNARYLKLQKALHPDNFVSSSALEQRVAMQKSTEVNDALKTLKDPILRAEAIIALNTGEQLDLEQKSTQDVAFLMQQLQWREQLEDVESQQDERALNVFAKEIKQETQSLLTALFESLKSQQWARASQYCDKLRFTHKLSEEIERVEERIFELD

SEQ ID NO: 3021 - protein, 107 aa, H. influenzae strain 86-028NP
MGITLTEKAAQRVKAFLDNRGKGIGLRLGVKTSGCSGLAYVLEFVDVLNSEDQVFEQHGVNIIVDPKSLVYLNGIELDYVKEGLNEGFKYNNPNVKESCGCGESFHV

SEQ ID NO: 3022 - protein, 126 aa, H. influenzae strain 86-028NP
MAYSEKVIDHYENPRNVGSLDKKDSNVGTGMVGAPACGDVMQLQIKVDDNGIIEDAKFKTYGCGSAIASSSLITEWVKGKSLEEAGAIKNSQIAEELELPPVKVHCSILAEDAIKAAIADYKAKQG

SEQ ID NO: 3023 - protein, 406 aa, H. influenzae strain 86-028NP
VKMKLPIYLDYAATCPVDERVAKKMMAFLTIDGTFGNPASRSHKFGWQAEEAVDIARNQIADLIGSDSREIVFTSGATESDNLAIKGAAHFYQTKGKHIITCKTEHKAVLDTCRQLEREGFEVTYLSPEADGLIDLEKFKAALRPDTILASIMHANNEIGVLQDIKAIGELCRANKTIFHVDATQSVGKVEINLEELAVDLMSMSSHKLYGPKGVGALYVRRKPRIRLEAIIHGGGHERGMRSGTLPVHQIVGMGEAYRIAKEEMASEMPRLKALRDRLYNGLKDIEETYVNGSMEHRLDSNLNISFNYVEGESLMMALRDIAVSSGSACTSASLEPSYVLRALGLNDELAHSSIRFTLGRYTTEEEIDYTINLMKGAVEKLRALSPLWDMFKEGIDLNTIEWSAH

SEQ ID NO: 3024 - protein, 150 aa, H. influenzae strain 86-028NP
MKLTSKGRYAVTAVLDIALNADGGPVSLADISERQHISLSYLEQLFAKLRKDGLVKSVRGPGGGYQLGLPSEQISVGMIIAAVNENIHVTKCLGRENCKNGVECLTHELWEDLSLRIESFLNEITLAELVNKRNVKRQSHRDFSNLLVNQ

SEQ ID NO: 3025 - protein, 241 aa, H. influenzae strain 86-028NP
MLENIRIVLIETSHSGNIGSAARAMKTMGLTQLCLVSPKSVDEQSYALSAGAENIVKNARVVDSFDEAVDDCSLVIGTSARLRHLQNTLIEPRECAEKVVAYKGKIAIVFGRERIGLTNEELLKCHYHLNIPANPDYSSLNLAMAVQLVSYELRMAFLVQNNKKNSLSLIEKNYPTTDQLAYFFDYTERIYQSLGFIQNQGVMRKLKRLYYRAKLEKNELNILNGMLSAVEKRIDLTKENN

SEQ ID NO: 3026 - protein, 153 aa, H. influenzae strain 86-028NP
MNKFVKSLLVAGSVAALAACSSSNNDAAGNGAAQTFGGYSVADLQQRYNTVYFGFDKYDITGEYVQILDAHAAYLNATPAAKVLVEGNTDERGTPEYNIALGQRRADAVKGYLAGKGVDAGKLGTVSYGEEKPAVLGHDEAAYSKNRRAVLAY

SEQ ID NO: 3027 - protein, 427 aa, H. influenzae strain 86-028NP
MKLLKRLVSVFAIVLAVGSNAFAGDEVRIVIDEGVDGARPIAVVPFVGSAPEDISKIVADDLRNSGKFNPIAVSQMPQRPTSAAEVNPEAWSNIGIDAIVIGQVVPSGNGYSITYQLIDTVGASGTPGAVLMQNSYTVTNKWLRYGAHTVSDEVFEKLTAIRGAFRTRIAYVVQKNGGSQPYEVRVADYDGYNQFIVNRSAQPIMSPAWSPDGQRLAYVSFENKKSQLVVQDLNSGARKVVASFQGHNGAPAFSPDGSRLAFASSRDGVLNIYVMGANGGTPTQLTSGAGNNTEPAWSPDGNSILFTSDRSGSPQVYRMDASGGSATAVGGRGSAQISADGKTLVMINGNNNVVKQDLTTGVSEVLSTSFLGESPSLSPNGIMIIYSSTQGLGKVLQLVSADGRFKASLPGSDGQVKFPAWSPYLTK

SEQ ID NO: 3028 - protein, 408 aa, H. influenzae strain 86-028NP
VQNNRQKKGINAFAISILLHFILFGLLILSSLYHTVEIMGGGEGEGDVIGAVIVDTGTAAQEWGRIQQQKKGQADKQKRPEPVVEEKPPEPNQEEIKHQQEVQRQEEIKHQQEVQRQEELKRQQEQQRQQEIKKQQEQARQEALEKQKQAEEARAKQAAEAAKLKADAEAKRLAAAAKQAEEEAKAKAAEIAAQKAKQEAETKAKLEAEAKAKAAAEAKAKAEAEAKAKAAAEAKAKAEAEAKAKAAAEAKAKADAEAKAKAAAEAKAAAEAKRKADQASLDDFFNGGDVGGGSASKGGNTNKGGTQGSGAALGSGDGGKVGDQYAGVIKKEIQRRFLKDPNFAGKVCRIKIQLGRDGTILGYQKISGSDDICSAALSAVARTKKVPAAPSDEIYEKYKSPIIDFDIR

SEQ ID NO: 3029 - protein, 139 aa, H. influenzae strain 86-028NP
MARRQRKAIKSEINIVPFLDVLLVLVLIFMATAPIISQSVQVELPDSVQSQEVSNEDKVPVILEVAGIGKYAISIGGERQEGLTEEMVTQLSRQEFDKDNNTLFLVGGAKEVPYEEVIKALNLLHLAGIKSVGLMTNPI

SEQ ID NO: 3030 - protein, 228 aa, H. influenzae strain 86-028NP
MTAELNFLDLFLKASIVVQLVIVILISFSIISWAIIIQRSRILTNALKEARTFEDRFWSGEDLNKLYEGLSNRRDGLTGSEQIFCVGFKEFSRLKQVNPDAPEAIIKGTMRAMNLAMNREIESLENRVPFLATVASVSPYIGLFGTVWGIMHAFMALSGAKQATLQMVAPGIAEALIATAIGLFAAIPAVMAYNRLSLRVNAIEQDYGNFIDEFTTILHRQAFGKAPH

SEQ ID NO: 3031 - protein, 136 aa, H. influenzae strain 86-028NP
MLDNCFSFPVRVYYEDTDAGGVVYHARYLHFFERARTEYLRTLNFTQQTLLEEQQLAFVVKTLAIDYCVAAKLDDLLMVETEVSEVKGATILFEQRLMRNTLMLSKATVKVACVDLGKMKPVAFPKEVKAAFHHLK

SEQ ID NO: 3032 - protein, 640 aa, H. influenzae strain 86-028NP
MDYENQIANIFSLNGELSQNIKGFRPRAEQLEMAHAVGKAIQNKSSLVIEAGTGTGKTFAYLAPALVFGKKTIISTGSKNLQDQLFNRDLPAIKKALNFTGKIALLKGRANYLCLERLDQVIAQGVLGDKSVLAELSKVRKWNNSTKTGDFTECIELAEDSPIIPQLTSTAESCLGTDCPNYSECYVASARKKALNADLVVVNHHLFFADMAVKESGFGELIPNAEVIIFDEAHQLPDIASQYFGQSLTSRQLFDLCKDINIVYRTELKDMQQLGTTSDTLLKVVQDFRLLLGNGSNVRGNWRELYKQSAVKKSFELLQEKIDFLAEVIKLALGRSQTLDSIFERVESIKIQLKRLSETNIVGYCYWYEGNGRQFGLHITPLTVADKFGAQLEAKEAAWIFTSATLEVGGTFNHFCQRLGIENATQKILYSPFNYSEQSLLCVPRYLPNTNQVNTLNSLGEMLLPVIEANKGRCFVLCTSYSMMRGLAEYFREKSHLSILLQGETSKGKLLEQFIKETHSVLVATSSFWEGVDVRGDALSLVIIDKLPFTAPDEPLLKARIEDCRLQGGDPFNDIQIPEAVITLKQGVGRLIRDVTDRGVVIICDNRLVMRNYGETFLKSLPNSSRTRDLNKVIQFLQNK

SEQ ID NO: 3033 - protein, 236 aa, H. influenzae strain 86-028NP
MQNLTLLALDTSTEACSVALLYRGEKTHINELAQRTHTKRILPMIDEILVNSGLGLNQVNALAFGRGPGSFTGVRVGAGIAQGLAFGADLPVIPISNLTAMAQAAFELHQAENVVAAIDARMNEVYFSQVVREKVRSDFGEVFQWREIIREQVCSPEQAINQLQNDNAFRVGTGWAAYSQFTKKNLTGSDIALPNALYMLELARVEFLQKHTIPALEIEPIYLRNEVTWKKLPGRE

SEQ ID NO: 3034 - protein, 183 aa, H. influenzae strain 86-028NP
MKGKITLFFTALCLGLTGCIAPPKGLEKERFSINSYREISPQDLTCHCKTVRLGGKIINTTVLANQTKIEVLSLPVSSISGKPFVELQSDGRFIVYFNGFVEPENLKERYITVGGQLAGTEKGKIEQADYTYPVVQADKYRIWTLSTIYEYPTDDWDEDDDWGFFRWRYRPWYVQPEIRYYLN

SEQ ID NO: 3035 - protein, 562 aa, H. influenzae strain 86-028NP
MEKIWFQNYPEGSEKFLDTSKYESILDMFDKAVREHPDRPAYINMGQVLTFRKLEERSRAFAAYLQNEFKLQRGDRVALMMPNLLQYPIALFGILRAGLIAVNVNPLYTPRELELQLQDSGAVAIVVVSNFASTLEKVVFNTNVKHVILTRMGDQLSFGKRTLVNFVVKYVKKLVPKYKLPHAVTFREVLSIGKYRQYVRPEISREDLAFLQYTGGTTGVAKGAMLTHGNIITNVFQAKWIAEPFIGDHSRTRSAILALPLYHVFALTVNCLLFLELGITAILITNPRDIEGFVKELKKYRFEAITGVNTLFNALLNNENFKEVDFSALKLSVGGGMAIQQSVATRWHELTGCNIIEGYGMTECSPLIAACPINVVKHNGTIGVPVPNTDIKIIKDDGSDAKIGEAGELWVKGDQVMRGYWQRPEATSEVLKDGWMATGDIVIMDESYSLRIVDRKKDIILVSGFNVYPNEIEDVVMLNYKVSEAVAIGIPHAVSGETIKIFVVKKDDSLTRDELRNHCRQYLTGYKVPKEIEFRDELPKTNVGKILRRVLRDEEIAKRPKH

SEQ ID NO: 3036 - protein, 380 aa, H. influenzae strain 86-028NP
MIKECQNPPHFRVISDNAALLEICNLAQMKSAVALDTEFMRVSTYFPKLGLIQLYDDERVSLIDPLAITDFSPFVALLSNPKVLKILHSCSEDLLVFLQEFDQLPRPMIDTQIMARFLGLGTSAGLAKLAQQYLNIEIDKGATRTNWIKRPLSDIQLQYAAGDVWYLLPLYHILEKELAKTPWEQAVRDDCELALAKTHKLQERDSEKAYLDIPNAWKLNPFELSRLRILAQWRQNVAIERDLALSYIVKSDNLWKVAKNNPRNTSEMLEMGLTENEVRVRGKKILQLLAQARRVSPNDYPKPIERISEDPRYKKTIRLLQEKVNSLTPAGLTPEILASKRTLDELIKWVWKYDCSQDKLPELLIGWRKPIAEKLVDILK

SEQ ID NO: 3037 - protein, 622 aa, H. influenzae strain 86-028NP; identical to SEQ ID NO: 668

SEQ ID NO: 3038 - protein, 363 aa, H. influenzae strain 86-028NP
MGFKCGIVGLPNVGKSTLFNALTKAGIEAANYPFCTIEPNTGVVPMPDPRLDALAEIVKPERILPTTMEFVDIAGLVAGASKGEGLGNKFLANIRETDAIGHVVRCFENDDIVHVAGKIDPLDDIETINTELALADLDSCERAIQRLQKRAKGGDKEAKFELSVMEKILPVLENAGMIRSVGLDKEELQAIKSYNFLTLKPTMYIANVNEDGFENNPYLDCVREIAEKEGAVVVPVCAAIESEIAELDDEEKVEFLQDLGIEEPGLNRVIRAGYALLNLQTYFTAGVKEVRAWTVSVGATAPKAAAVIHTDFEKGFIRAEVIAYEDFIQFNGENGAKEAGKWRLEGKDYIVQDGDVMHFRFNV

SEQ ID NO: 3039 - protein, 194 aa, H. influenzae strain 86-028NP
MSEIKLIVGLGNPGEKYADTRHNAGEWLIERLARRFNVSLNPESKFFGKTARTLVNGKEVRLLVPTTFMNLSGKAVGALASFYRIKPEEILVIHDELDLPAGTAKLKQGGGHGGHNGLKDIVAQLGNNNNFYRLRIGIGHPGHRDLVAGYVLNKPSPADRDALEKVLDEATDCVEIIFKDGMIKATNRLNSFKI

SEQ ID NO: 3040 - protein, 102 aa, H. influenzae strain 86-028NP
MNQINIEIAYAFPERYYLKSFQVDEGITVQTAITQSGILSQFPEIDLSTNKIGIFSRPIKLTDVLKEGDRIEIYRPLLADPKEIRRKRAAEQAAAKDKEKGA

SEQ ID NO: 3041 - protein, 404 aa, H. influenzae strain 86-028NP
MTALSSVDFCLPEHITPEIFLRDYWQKKPLVIRNGLPEIVGQFEPQDIIELAQNEDVTARLVKTFSDDDWKVFFSPLSEKDFQKLPEKWSVLVQNLEQWSPELGQLWNKFGFIPQWQRDDIMVSYAPKGGSVGKHYDEYDVFLVQGYGHRRWQVGKWCDASTEFKPNQSIRIFDDMGELVIDEVMNPGDILYIPARMAHYGVAEDDCLTFSFGLRYPNLSNLIDGISKGFCHQDPDLNLSEFDLPLRLSQSEQRTGKLADENIQAMKQLLLDKLAHSEAFDTLFKQAVASAVSSRRYELLVSDEMCDPDEVRSILEEDGAFLSQDNNCKLLYTENPLRIYANGEWLDELNIIESEVLKRLSDGESLDWAFLSDLANKTEDPETSMDLLLDSICNWVDDGWALIE

SEQ ID NO: 3042 - protein, 439 aa, H. influenzae strain 86-028NP
MSDNIYSVSQLNSAARQMLEGNFSQIWLTGEISNFTQPVSGHWYLTLKDENAQVRCAMFRMKNLRVAFRPQNGMQVLVRANVSLYEPRGDYQLIIDSMHPAGEGLLQQQFEALKMKLAAEGLFAQNLKKTLPHFSKAVGIITSSTGAALQDILHILARRDPSLKVVIYPTAVQGKEATAEIVQMIELANARQEVDVLIVGRGGGSLEDLWCFNEEEVARAIFRSTLPIISAVGHETDVTIADFVADLRAPTPSAAAELVSRNQDELLQQLRHQQQRLDMAFDRLFTRKSQRLKQLALRLQNQHPQNQLRAQQAKNEQLTHRLQLAILRQFENTQQKFTALSVRLKQNPLPYRIQRYQQGLEQLKVRLNFCVNRQVTERQNKLATLCGKLDGLSPLKVLARGYSIAENPQGKAIVSVKDVNQGDFITTQVADGKIVSKVL

SEQ ID NO: 3043 - protein, 217 aa, H. influenzae strain 86-028NP
VQFWRKQMSEIQHFSQQDIEILGEQTLYEGFFTLKRIQFKHKLFAGGQSGVVTRELLIKGAASAVIAYDPKEDSVILVEQVRIGAAYHPESNRSPWLLELIAGMVEKGEKPEEVALRESEEEAGIQVKNLTHCLSVWDSPGGIVERIHLFAGEVDSTQAKGIHGLAEENEDIKVHVVKREQAYQWMCEGKIDNGIAVIGLQWLQLNYAQLQQSWKRS

SEQ ID NO: 3044 - protein, 274 aa, H. influenzae strain 86-028NP
MKNTFVYQAEKPVIKLLQITDPHLFKDESAELLGVNTQASFAQVLKEIQQENNQFDVILATGDLVQDSSDEGYIRFVEMMKPFNKPVFWIPGNHDFQPKMAEFLNQPPMNAAKHLLLGEHWQALLLDSQVYGVPHGQLSQHQLDLLKETLEKNPERYTLVVLHHHLLPTNSAWLDQHNLRNSHELAEVLAPFSNVKAILYGHIHQEVNSEWNGYQVMATPATCIQFKPDCQYFSLDTLQPGWREIELYSDGSIRTEVKRIQQAEFLPNMQEEGY

SEQ ID NO: 3045 - protein, 95 aa, H. influenzae strain 86-028NP
MTVKCKAEESLTCSCVDVGTIIDGSDCSVEVHQVYSTEADANAALERLTKKARDIESDPCEIKSEIVAVENGVQLNASFTFSCQAEAMIFELANR

SEQ ID NO: 3046 - protein, 458 aa, H. influenzae strain 86-028NP
MKKFNQSLLATAMLLAAGGANAAAFQLAEVSTSGLGRAYAGEAAIADNASVVATNPALMSLFKTAQFSTGGVYVDSRINMNGDVNSYATITSASSGVRTIKHGSASQRNVVPGAFVPNLYFVAPVNDKFALGAGMNVNFGLKSEYDDSYDAGVFGGKTDLSAINLNLSGAYRVTEGLSLGLGVNAVYANAQVERNAGIIVETIDNQVNTALSALQEPFRDLKKHLPSKDKSVVSLQDRAAWGFGWNAGVMYQFNEANRIGLAYHSKVDIDFTDRTATSLEANVIKAGKKGDLTFTLPDYLELSGFHQLTDKLAVHYSYKYTHWSRLTKLHASFEDGKKAFEKELQYSNNSRVALGASYNLYEKLTLRAGIAYDQAASRHQRSAAIPDTDRTWYSLGATYKFTPNLSVDLGYAYLKGKKVHFKEVKTIGEPRALTFNTTANYTSQAHANLYGLNLNYSF

SEQ ID NO: 3047 - protein, 189 aa, H. influenzae strain 86-028NP
VLFFYKTRRKMTALYYTYYPSPVGRLLILSDGESITHIDFEKEQYAPNPKWLKQDELPVFQKVRLAFERYFNGEVERFADIPLKPEGTAFQQAIWQALREIAYGELSTYGELALRINNPKAVRAVGGAVGSNPISIIIPCHRILGKDRTLTGFGGGLEAKRFLLQLEKIPYIDKGTENTKPRFFKKYHE

SEQ ID NO: 3048 - protein, 223 aa, H. influenzae strain 86-028NP
MIPQTLEQLLSQAQSIAGLTFGELADELHIPVPIDLKRDKGWVGMLLERALGATAGSKAEQDFSHLGVELKTLPINAEGYPLETTFVSLAPLVQNSGIKWENSHVRHKLSCVLWIPIEGSRHIPLRERHIGAPIFWKPTAEQERQLKQDWEELMDLIVLGKLEQITARIGEVMQLRPKGANSRAVTKGIGKNGEIIDTLPLGFYLRKEFTAQILKAFLDVKPL

SEQ ID NO: 3049 - protein, 430 aa, H. influenzae strain 86-028NP
MDLLSDIEKQLQKATAQGFLIALSGGLDSTVLLSLFAKLCQKQPHLPPLSVRAIHIHHGLSPNADSWAKHCQNLCDQFQIPLIIERVQVDKTNGIEAGAREARYQAIKKHLQIQEMLVTAHHLNDQTETFFLALKRGSGLQGLSAMQQQSVLFGMPIFRPLLGFTRPQLEDYAQQEKLNWVTDESNEDNRYDRNFLRNEILPKLRERWAHFDLAVQRSAQHCFEQQQLINDLLSEIFTEHCQIKNQFKLLQFRQYSLAKQTALLRMWLAKNQLEMPSKRQLTQLINDVIFAKEEANPQFQLVNKVIRRYQDSLYLTKPFSDLTKCTLKLEQNMLNLPDDLGNLTVHENEHNLIFYWQDYSVTLEKTNLPISIRFGYSGKVKHHPKRPREDIKKIWQELSVPPWERNRIPLIFYGNELKSAVGFFRVFDEY

SEQ ID NO: 3050 - protein, 315 aa, H. influenzae strain 86-028NP
MNQEYLDFELPIAELEAKIEALRAASDDKVDLTDEIKRLQKKSNELTKKTFANLDAWQVSRMARHPNRPYTLDYIEHIFTEFEELAGDRAFADDKAIVGGLARLDGRPVMVIGHQKGRSVKEKVQRNFGMPAPEGYRKALRLMEMAERFKLPIITFIDTPGAYPGIGAEERGQAEAIARNLREMAQLTVPVICTVIGEGGSGGALAIGVGDKVNMLQYSTYSVISPEGCASILWKSAEKASTAAEVMGLTASRLKELNLIDSIMQEPLGGAHRNYAKIAENLKLRLKEDLAELDELSKEELLNRRYERLMSYGYC

SEQ ID NO: 3051 - protein, 261 aa, H. influenzae strain 86-028NP
MFEILFPALLTGIVLSLITAPLGVFVVWRKMAYFGDTLSHSALLGVALGIFLQVNPYIAIVVLTLILAIAMVWLESNTQFSIDTLLGIIAHSCLSLGVVTVGLLRNVRVDLMNYLFGDLLAINYTDLIYIGIGVIIVLSTLIYFWQSLLSTTVSPELAQVEGINIKKMRFILMILTALTIALSMKFVGALIITSLLIIPAATARRFARTPESMVGWAIIMSMLSIIGGLILSAFYDTAAGPSVVICSAFLFVLSLFKKERL

SEQ ID NO: 3052 - protein, 268 aa, H. influenzae strain 86-028NP
MNITAIRNEQNPQPLIQLKNINVVFAQKTALQDINLNIYPNSIITIVGPNGGGKSTLLKTLLKLQMPTSGEVIYSKNVRIGYVPQKIHLDHSLPITVERFLSLKKGIKTQEISTALEQLSISHLRKSNMQKLSGGEMQRVLLTRAILNKPNLLVLDEPTQGVDITGQAELYQLIHQTQQKLNCAVLMVSHDLHIVMADSKEVLCINQHICCAGTPDVLSNDPTFMRLWGNQIAQNVGFYTHHHNHHHTLHGDVCGCNSSAVHCQNKDK

SEQ ID NO: 3053 - protein, 475 aa, H. influenzae strain 86-028NP
MPVQHVKLARDRRKKRTYIKVGVFFVAILLILTGILLTIKDKSEENPIFSTSDSGEYHELNTSPNKNSTALQPDEDATSYDDELQAKDDEVDEVKLSSDDLGTLPQHAQDALNGLLDAADQAIRITDQFSYTVTEGDTLKDVLVLSGLDDSSVQPLIKLDPELAHLKAGQQFYWILNKNDNLEYLNWLVSEKEERIYERLEDGKFKRQVIEKKSIWRKEVLKGEIQNSLNSSLREQGLDTRQISQLSNALQWQVSLRKLKKGTQFAILVSREYLGDKLTGQGNVEALRISSGGKNYYAVQAANGRYYNQQGETLGKGFARYPLQRQARVSSPFNPNRRHPVTGRVRPHKGVDFSVSQGTPVIAPADGTVEKVAYQAGGAGRYVMLRHGREYQTVYMHLSKSLVKAGQTVKKGERIALSGNTGISTGPHLHYEFRINGRAVNPLTVKLPGTSSGMTSAERKQFLVRVREAEKMLKP

SEQ ID NO: 3054 - protein, 318 aa, H. influenzae strain 86-028NP
MTISKFNPQKPFECFIVQSEAMKSAVENAKRFAMFDVPLLIQGETGTGKDLLAKACHYQSLRRDKKFIAVNCAGLPDEDAESEMFGRKVGDSETIGFFEYANEGTVLLDGIAELSLGLQAKLLRFLTDGSFRRVGEEKEHYANVRVICTSQVPLHLLVEQGKVRADLFHRLNVLTLNVPPLRERMTDIEPLAQGFLQEISEELKIAKPTFDKDFLLYLQKYDWKGNVRELYNTLYRACSLVQDNHLTIESLNLAPPQSAVISLDEFGNKTLDEIIGSYEAQVLKLFYAEYPSTRKLAQRLGVSHTAIANKLKQYGIGK

SEQ ID NO: 3055 - protein, 91 aa, H. influenzae strain 86-028NP
MAKGQSLQDPYLNALRRERIPVSIYLVNGIKLQGQIESFDQFVILLKNTVNQMVYKHAISTVVPARSVSHHNNNHHTTPTEAVENVETQAE

SEQ ID NO: 3056 - protein, 331 aa, H. influenzae strain 86-028NP
LHRFSKGKKMTKQNEKIINSSVKMLTISEDESGQRIDNYLLAKLKGVPKSLIYRIVRKGEVRVNKGRIKPEYKLQTGDVVRIPPVRVAEKNDAPISKNLNKVAALENQILFEDDCLIILNKPSGIAVHGGSGLNFGVIEALRALRPEARFLELVHRLDRDTSGILLIAKKRSALRNLHEQLRVKTVQKDYLALVRGQWQSHIKVIQAPLLKNELSSGERIVRVSEQGKPSETRFSIEERYINATLVKASPVTGRTHQIRVHTQYAGHPIALDDKYGDKDFDKQMNELGLNRLFLHAFSIRFEHPKNGETLRFNASLDHQMKAILQKLRESK

SEQ ID NO: 3057 - protein, 951 aa, H. influenzae strain 86-028NP
VRFILRFFKYLIRELTMKRMLINATQKEELRVALVDGQRLFDLDIESPGHEQKKANIYKGKITRVEPSLEAAFVDYGAERHGFLPLKEIAREYFPDDYVFQGRPNIRDILTEGQEVIVQVNKEERGNKGAALTTFVSLAGSYLVLMPNNPRAGGISRRIEGDERTELKEALSSLDVPEGVGLIVRTAGVGKSPEELQWDLKVLLHHWEAIKQASQSRPAPFLIHQESDVIVRAIRDYLRRDIGEILIDSPKIFEKAKEHIKLVRPDFINRVKLYQGEVPLFSHYQIESQIESAFQREVRLPSGGSIVIDVTEALTAIDINSARSTRGGDIEETALNTNLEAADEIARQLRLRDLGGLVVIDFIDMTPIRHQREVENRIRDAVRPDRARIQISRISRFGLLEMSRQRLSPSLGESSHHICPRCQGTGKVRDNESLSLSILRLLEEEALKENTKQVHTIVPVQIASYLLNEKRKAISNIEKRHNVDIIVAPNEAMETPHFSVFRLRDGEEVNELSYNLAKIHCAQDENTEESLLSRNVETTAVIEQPAVESAVVALSISEAAPTPVERKSNEPSLLAKIIAKIKGLFATKSEENKPKNNRTSRNPNRNQRRSQDRRSSRRPRSENNETERTEEQVRNVRERNQRRPRRNLVEESIAESAVNSTPVFEAKEERTEPVTQRRQRRDLRKRVRVEDNETVVENNFSTTEKMPEVDVITVQNNDEKPVHQNQRSERQERQRRTPRHLRAANNQRRRRNQEPKSPMPLFAAVVSPELASGKAWIDYSTVNLPKENHFLSVDELLEQEKTKKGFITPAMGIVVEEKSPDVKPALDFITQPANESVQKKVQESLDRLSSYKPQEVVESIDPAINVDEPETLEKVSKFVRTYEFNGRLGTISSVPHTKAEMTLAKANDEMPEAFPIRAWQDSRYYFYGKGAAGHHCAISHVYSEPTRAKSE

SEQ ID NO: 3058 - protein, 70 aa, H. influenzae strain 86-028NP
MPIGGDVKADQETSGSRSIKRIGFGFIGGIGYDITPNITLDLDYRYNDWGRLENVRFKTHEASFGVRYRF

SEQ ID NO: 3059 - protein, 265 aa, H. influenzae strain 86-028NP
MLMQSIYLSKIREQNPLIHNITNIVAANFSANGLLALGASPLMSANIEEMQEVPKISQVLVINIGTLIGKDREAMLQAGKTANEVGIPVVLDPVGVGATSYRRETIRQLLAEVKFALIRGNAGELAAIAGETWQAKGVDAGQGEVDLKAVAEKVAQRYGCTVLISGAVDIVSDGTQTATVHNGTSLFPKVTASGCLLSAVCAAFLAVSEGNYFSATLEACVAYTIAGECAAQGLTTQVGQFQIRLLDELAALSPETIGQRGRINE

SEQ ID NO: 3060 - protein, 269 aa, H. influenzae strain 86-028NP
MSNVKQVLTIAGSDSGGGAGIQADLKTFQMRGVFGTSVITAVTAQNTLGVFDIHPIPLKTIQAQLEAVKNDFQIASCKIGMLGNAEIIECVADFLADKPFGTLVLDPVMIAKGGAPLLQQQAVSALSQKLLPLADVITPNIPEAEALTGIAIVDDISIQQAAKALQKQGAKNVIIKGGHSLNSQSELCQDWVLLADGRHFTLQSPRFNTPHTHGTGCTFSACLTAELAKGEPLQSAVKTAKDFITAAISHPLNIGQGHGPTNHWAYSRL

SEQ ID NO: 3061 - protein, 226 aa, H. influenzae strain 86-028NP
MKNIQKILPLYFVAGTQDCRHLGENLSENLLFVLKQALEGGITCFQFRDKGKFSLEHTPSAQKALAMSCRDLCREYGVPFIVDDNVDLALEIEADGIHVGQSDMPVQEIRAKTDKPLIIGWSVNRLDEAKIGENLAEIDYFGIGPIFPTQSKENPKPTLGMAFIQTLRNVGITKPLVAIGGVKLAHVKTLREFGADGVAVITAITHADNVQAATKALREASDEYAK

SEQ ID NO: 3062 - protein, 434 aa, H. influenzae strain 86-028NP
MNTQNSLKQVATATMVGTAIEYFDNYIYAIAAVLVFNHQFFHVADPLSGQIAALSTLALTFIARPLGAILFGHFGDRFGRKNTFVMSLLLMGVSTVVIGLLPTYDSIGIWATILLCLCRIGQGIGLGGEWGGAALVAVENAPEGKRGWYGTFPQLGAPLGLLLANGVFLGITAIFGQEAMTEWAWRIPFLSSVILVAIGLYVRLKLTEAPIFLAALNKPQPKRLPMLEVVTTYFKPFFLGMLICIAGYVLFYIMIAFSQIYAKSAPTVSEAGYAMGLGLSPQIFTALLMASAVSLAITIAVSGKYIDKIGRRIWLIWTTVGVAIFGLSLPLFLENGTTTSLFWFLFIGMGLIGMGYGPLASFLPELFPTHARYSGASLTYNIAGLFGASVAAIIALPLNAHYGLKGVGIYLTLNAVLSLVGLWFISETKDKLLS

SEQ ID NO: 3063 - protein, 33 aa, H. influenzae strain 86-028NP
VGYCRENIWLVKESAVKFLVEFYVKFNRLIDCI

SEQ ID NO: 3064 - protein, 459 aa, H. influenzae strain 86-028NP
MTTQFKPELLSPAGSLKNMRYAFAYGADAVYAGQPRYSLRVRNNEFNHANLKIGIDEAHSLGKKFYVVVNIAPHNSKLKTFIKDLQPVIDMKPDALIMSDPGLIMLVRENFPNIDIHLSVQANAVNWATVKFWKQMGLTRVILSRELSIDEIAEIRQQMPDIELEIFVHGALCMAYSGRCLLSGYINKRDPNQGTCTNACRWEYKMEEGTTDEVGNIVPKIDPAQQIEVKNVAPTLGDGTVTDKVFLYTESQKPDEQMTAFEDEHGTYFMNSKDLRAVQHVEKLTALGVHSLKIEGRTKSFYYCARTAQVYRKAIDDAAAGKPFDESLMDTLESLAHRGYTEGFLRRHTHDEYQNYEYGYSISDRQQFVGEFTGKRNEQGMAEVAVKNKFLLGDNVEMMTPQGNINFKIEKMLNRKNETVDAALGDGHFVFLNVPQDINLNYALLMRNLVNTNTRNPHC

SEQ ID NO: 3065 - protein, 439 aa, H. influenzae strain 86-028NP
MNLSQFEQFDLSPELLKALEKKGYSRPTAIQMEAIPAAMEERDVLGSAPTGTGKTAAFLLPALQHLLDYPRRKPGPPCILILTPTRELAMQVAEQAEELAQFTHLNIATITGGVAYQNHGDVFNTNQDLVVATPGRLLQYIKEENFDCRSVEMLIFDEADRMLQMGFGQDAEKIAAETRWRKQTLLFSATLEGELLVDFAERLLNDPVKVDAEPSRRERKKINQWYYHADSNEHKIKLLARFIETEKVTRGIVFVRRREDAREVSETLRKRGIRSAYLEGEMAQTQRNNAIDKLKSGIVTVLVATDVAARGIDIDDVSHVMNFDLPYSADTYLHRIGRTARAGKKGTAVSFVEAHDYKLLGKIKRYTEEILKARILAGLEPRTKPPKDGEVKSVSKKQKARIKKKREEKKKTEAKKKVKLRHKDTKNIGKRRKPSNSNV

SEQ ID NO: 3066 - protein, 240 aa, H. influenzae strain 86-028NP
VRSIYEKFMSGFTFKQFHINQDSCAMKVGTDGILLGAWADVKHCKNILDMGSGTGLLTLMLAQRTEENCQIQAVELDPIAAKQAQENINNSVWKNRIQLTQADIQHFLQTTEQTFDLIVANPPYFEQGIACKNEERELARYTKQSHLNWLEWAATRLSENGKISFVLPYDAGKTLTKSTALFCIKQTNVITKIGKTPQRMLLTFAKQPEVLMQDQLVIYDADNQYTEAFIELTKDFYLKF

SEQ ID NO: 3067 - protein, 455 aa, H. influenzae strain 86-028NP
MLINKTKRAEQNLNNLPFLALQAEQIEFLGSSAEFKTQIIELIRNAKKRIYVTALYWQKDEAGQEILDEIYRVKQENPHLDVKILIDWHRAQRNLLGAEKSATNADWYCEQRQTYQLPDDPNMFFGVPINTREVFGVLHVKGFVFDDTVLYSGASINNVYLHQFEKYRYDRYQKITHAELADSMVNFINDYLLDFSAVYPLDVTNRPRTKEIRGNIRAYRKDLAQNGEYSLKSAVKLPNVLSVSPLFGLGASGNELNQVIEDLFLQVQEKLVICTPYFNFPRTLQHKIATLLESGKQVEIIVGDKVANDFYIPPEQPFKMAGALPYLYESNLRRFCEKFETQIENGQLVVRLWRDGDNTYHLKGVWVDDRYILLTGNNLNPRAWRLDAENGLLIYDPQQQLLAQVEKEQNQIRQHTKVLKHYSELEELNQYPEPVQKLLKKFARIKADKLVKMIL

SEQ ID NO: 3068 - protein, 241 aa, H. influenzae strain 86-028NP
MQNNNDILKAQSPAALAEEYIVKSIWQDVFPSGSNLPSERDLADKIGVTRTTLREVLQRLARDGWLTIQHGKPTKVNNIWDAAGPNIIETLIALDMQSAPLIIDNMLSLRSKMSESYIYEAVKNSPQKSTALFAELEQLQNTAQDYTEFDYQLFRQFTVVANKPFYRLIFNSLKGVYQRIGLLFFKEKKHRELTKQFYLEMQQICLEGNADAVVDCIRKHNLRSSTYWKAILERLPQNLSD

SEQ ID NO: 3069 - protein, 522 aa, H. influenzae strain 86-028NP
VIKIMEFTMTNIQAFMKNFLGASPEWYKLAIVVFLIINPIVFFFISPFIAGWLLVAEFIFTLAMALKCYPLQPGGLLAIEAIIIGMTNAKHVKAEIMANFEVILLLIFMVAGIFFMKQLLLYVFTKLLVKIRSKIALSIAFCFSAAFLSAFLDALTVVAVIISVAMGFYGVYHKVASGNNLIDAVDISDDRKIIEQQHEILEKFRAFLRSLMMHAGVGTALGGVMTVVGEPQNLIIAEQAKWNFMEFFLRMAPVTIPVFICGLLTCFLVEKFKLFGYGEKLPDEVWKVLSDLDRTNSEKMSKQDKIKLGMQALIAIWLILGLAFHLAAVGLIGLSIIIFATSFTGVTDEHTIGKAFQESLPFTALLVVFFSVVAVIIDQKLFSPIIHFVLSAEENTQLALFYLFNGLLSSISDNVFVATVYINEAKAALTNGVIAPHQFELLSVAINTGTNLPSVATPNGQAAFLFLLTSSISPLIRLSYGRMVYMALPYTIVLSIIGLLAIEFILPAATIWLASLGLILPI

SEQ ID NO: 3070 - protein, 177 aa, H. influenzae strain 86-028NP; identical to SEQ ID NO: 630

SEQ ID NO: 3071 - protein, 610 aa, H. influenzae strain 86-028NP
MCGIVGAVAQRDVAEILINGLHRLEYRGYDSAGVAVINKQNELQRIRCLGKVKALDEAVSEKPLIGGTGIAHTRWATHGEPSETNAHPHSSGTFAVVHNGIIENHEELRELLKSRGYVFLSQTDTEVIAHLVEWEMRSTDSLLEAVQKSVKQLTGAYGMVVMDSRHPEHLVAARSGSPLVIGLGIGENFLASDQLALLSVTRRFIFLEEGDIAEITRRTVDIYDTHGNKAKREIHESNLENDAAEKGKFRHFMQKEIYEQPTALINTMEGRINHENVIVDSIGNGAKGILEKVEHIQIVACGTSYNAGMVARYWFESLAGVSCDVEIASEFRYRKFVTRPNSLLITLSQSGETADTLAALRLAKEKGYMAALTICNVAGSSLVRESDLAFMTRAGVEVGVASTKAFTTQLAALLMLVTALGKVKGHISVEKEREIIKAMQSLPAEIEKALAFDREIEALAEDFAEKHHALFLGRGAFYPIAVEASLKLKEISYIHAEAYAAGELKHGPLALIDADMPVIVVAPNNELLEKVKSNIEEVRARGGQLYVFADKEAGFTPSEGMKIITMPKVNDIVAPIFYTIPMQLLSYYVALIKGTDVDQPRNLAKSVTVE

SEQ ID NO: 3072 - protein, 136 aa, H. influenzae strain 86-028NP
VRFVTIFINHAFNSSQVRLSFAQFLRQIRKDTFKESNFLFNRRYKFMNKTDLIDAIANAAELNKKQAKAALEATLDAITASLKEGEPVQLIGFGTFKVNERAARTGRNPQTGAEIQIAASKVPAFVSGKALKDAIK

SEQ ID NO: 3073 - protein, 196 aa, H. influenzae strain 86-028NP
MRNPIHKRLENLDSWQHLTFMAALCERMAPNFKLFCQMNELSVETKTYQNILNLVWEYLTIKDVKINFENQLEKLESIIPDVNDYDSFGVVPALDACQALAEILHAIIAGETLEKAVEISLISLGTVRALLETETGRDWSESKLKENEDIQTELDVQWQVYRLLKECEKRDIELILALKNEIRTEGISNIGIEFHQ

SEQ ID NO: 3074 - protein, 264 aa, H. influenzae strain 86-028NP
MKILQQDDFGYWLLTQGSNLYLVNNELPFGIAKDIDLEGLQAMQIGEWKNHPLWLVAEQESDEREYVSLRNLLSLPEDEFHILSRGVEINHFLKTHKFCGKCGHKTQQTQDELAVQCIHCGYQTYPVICPSIIVAVRRGHEILLANHKRHYSPNGGIYTTLAGFVEVGETFEQAVQREVFEETGISIKNLRYFGSQPWAFPNSQMVGFLADYESGEITLQESEIHDAQWFSYDQPLPELPPTGTIARKLIHVTLELCKAEHKCD

SEQ ID NO: 3075 - protein, 198 aa, H. influenzae strain 86-028NP
MEQATQQIAISDAAQAHFRKLLDTQEEGTNIRIFVVNPGTPNAECGVSYCPPNAVEESDIEMKYNTFSAFIDEVSLPFLEEAEIDYVTEELGAQLTLKAPNAKMRKVADDAPLIERVEYVIQTQINPQLANHGGRITLIEITEDGYAVLQFGGGCNGCSMVDVTLKDGVEKQLVSLFPNELKGAKDITEHQRGEHSYY

SEQ ID NO: 3076 - protein, 228 aa, H. influenzae strain 86-028NP
MNFFNFRCIHCRGNLHIAKNGLCSGCQKQIKSFPYCGHCGAELQYYAQHCGNCLKQEPSWDKMVIIGHYIEPLSILIHRFKFQNQFWIDRTLARLLYLAVRDAKRTHQLKLPEAIIPVPLYHFRQWRRGYNQADLLSRQLSRWLDIPNLSNIVKRVKHTYTQRGLSAKDRRQNLKNAFSLVVSKNEFPYRRVALVDDVITTGSTLNEISKLLRKLGVEEIQVWGLARA

SEQ ID NO: 3077 - protein, 445 aa, H. influenzae strain 86-028NP
MKKYFLKCGYFLVCFCLPLIVFANPKTDNECFFIRLSQAPLAQTLEQLAFQQDVNLVMGERLEGNISLKLNNIDMPRLLKIIAKSKHLTLNKDDGVYYLNGSQSGKGQVAGNLTTNEPHLVSHTVKLHFAKASELMKSLTTGSGSLLSSAGSITFDDRSNLLVIQDEPRFVQNIKKLIAEMDKPIEQIAIEARIVTITDESLKELGVRWGIFNPTENARRVAGSLTGNSFENIADNLNVNFATTTTPAGSIALQVAKINGRLLDLELSALERENNVEIIASPRLLTTNKKSASIKQGTEIPYIVSNTRNDTQSVEFREAVLGLEVTPHISKDNNILLDLLVSQNSPGSRVAYGQNEVVSIDKQEINTQVFAKDGETIVLGGVFHDTITKSEDKVPLLGDIPVIKRLFSKESERHQKRELVIFVTPHILKAGETLEALKQKSAGKK

SEQ ID NO: 3078 - protein, 137 aa, H. influenzae strain 86-028NP
MKHWFFLIILFFMNCSWGQDPFDKTQRNRSQFDNAQTVMEQTEIISSDVPNNLCGADENRQAAEIPLNALKLVGVVISKDKAFALLQDQGLQIYSVLEGVDVAQEGYIVEKINQNNVQFMRKLGEQCDSSEWKKLSF

SEQ ID NO: 3079 - protein, 173 aa, H. influenzae strain 86-028NP
MKAFFNDPFTPFGKWLSQPFYVHGLTFLLLLSAVIFRPVLDYIEGSSRFHEIENELAVKRSELLHQQKILTSLQQQSESRKLSPELAAQIIPLNKQIQRLAARNGLSQHLRWEMGQKPILHLQLTGHFEKTKTFLTALLANSSQLSVSRLQFIKPEDNPLQTEIIFQLDKETK

SEQ ID NO: 3080 - protein, 168 aa, H. influenzae strain 86-028NP
MSMNLLPWRTYQHQKRLRRLAFYIALFILLAINLMLAFSNLIEQQKQNLQAQQTSFEQLNQQLHKTTMQIDQLRSAVKVGEVLTSIPNEQVKKSLQQLSELPFQQGELNKFKQDANNLSLEGNAQDQTEFELIHQFLKKHFPNVKLSQVQPEQDTLFFHFDVEQGAEK

SEQ ID NO: 3081 - protein, 265 aa, H. influenzae strain 86-028NP
MQFSLKNYRTLQIGIHRKQGYFDFVWFDDLEQPQSYQIFVNDRDFKNRFLQQLKTQYQGKTFPLQFVASIPAHLTWSKVLMLPQVLNAQECHQQCKFVIEKELPISLNELWFDYRSTSLKQGFRLDVTAIRKSTAQTYLQDFQPFKINVLDVASNAILRAFQYLLNEQVRSENTLFLFQEDDYCLAICERSQQSQILQSHENLTALYEQFTERFEGQLEQVFVYQIPSSHTPLPENWQRVETELPFIALGNALWQKDLHQQKVGG

SEQ ID NO: 3082 - protein, 864 aa, H. influenzae strain 86-028NP
MRIAKLILNTLLTLCILGLVAGGMLYFHLKSELPSVETLRTVELQQPMQIYTADGKLIGEVGEQRRIPVKLADVPQRLIDAFLATEDNRFYDHHGLDPIGIARALFVAVSNGGASQGASTITQQLARNFFLTPEKTIIRKAREAVLAVEIENTLNKQEILELYLNKIFLGYRSYGVAAAAQTYFGKALNELTLSEMAIIAGLPKAPSTMNPLYSLKRSEERRNVVLSRMLDEKYISKEEYDAALKEPIVASYHGAKFEFRADYVTEMVRQEMVRRFGEENAYTSGYKVFTTVLSKDQAEAQKAVRNNLIDYDMRHGYRSGAPLWQKNEAAWDNDRIVGFLRKLPDSEPFIPAAVIEIAKGGADILLASGEKMTLSTNAMRWTGRSNPVKVGEQIWIRQRANGEWQLGQIPAANSALVSLNSDNGAIEAVVGGFSYEQSKFNRATQSLVQVGSSIKPFIYAAALEKGLTLSSVLQDSPISIQKPGQKMWQPKNSPDRYDGPMRLRVGLGQSKNMIAIRAIQTAGIDFTAEFLQRFGFKRDQYFASEALALGAASFTPLEMARAYAVFDNGGFLIEPYIIEKIQDNTGKDLFIANPKIACIECNDIPVIYGETKDKINGFANIPLGESALKPTDDSTNGEELDQQPETVPELPELQSNFTALKEDAIDLMAAAKNASSKIEYAPRVISGELAFLIRSALNTAIYGEQGLDWKGTSWRIAQSIKRSDIGGKTGTTNSSKVAWYAGFGANLVTTTYVGFDDNKRVLGRGEAGAKTAMPAWITYMKMALSDKPERKLPLPPKIVEKNIDTLTGLLSPNGGRKEYFIVGTEPTRTYLSEMQERGYYVPTELQQRLNNEGNTPATQPQELF

SEQ ID NO: 3083 - protein, 281 aa, H. influenzae strain 86-028NP
MLSYRHSFHAGNHADVLKHIVLMLILENLKLKEKGFFYLDTHSGVGRYRLSSNESKKTGEYKEGIGRLWDQTDLPEDVARYVKMIKKLNYGGKELRYYAGSPLIAAELLRPQDRALLTELHPSDYPILRNNFSDDKNVTVKCDNGFQQVKATLPPKERRGLVLIDPPYELKDDYDLVVKAIEEGYKRFATGTYAIWYPVVLRQQTKRIFKGLEATGIRKILRIELAVRPDSDQRGMTASGMVVINPPWTLETQMKEILPYLTKTLVPEGTGSWTVEWITPE

SEQ ID NO: 3084 - protein, 121 aa, H. influenzae strain 86-028NP
MHAIFDLIKDNIMFGKGGLGGLMKQAQQMQEKMQKMQEEIAQLEVTGESGAGLVKITINGAHNCRRIDIDPSLMEDDKEMLEDLIAAAFNDAVRRAEELQKEKMASVTAGMPLPPGMKFPF

SEQ ID NO: 3085 - protein, 200 aa, H. influenzae strain 86-028NP
MQSSPLLEHLIENLRCLPGVGPKSAQRMAYHLLQRNRSGGMNLARALTEAMSKIGHCSQCRDFTEEDTCNICNNPRRQNSGLLCVVEMPADIQAIEQTGQFSGRYFVLMGHLSPLDGIGPREIGLDLLQKRLVEESFHEVILATNPTVEGDATANYIAEMCRQHNIKVSRIAHGIPVGGELETVDGTTLTHSFLGRRQID

SEQ ID NO: 3086 - protein, 651 aa, H. influenzae strain 86-028NP
MRLFIAEKPSLARAIADVLPKPHQRGDGFIKCGDNDVVTWCVGHLLEQAEPDAYDPKFKQWRLEHLPIIPEKWQLLPRKEVKKQLSVVEKLIHQADTLVNAGDPDREGQLLVDEVFSYANLSAEKRDKILRCLISDLNPSAVEKAVKKLQPNRNFIPLATSALARARADWLYGINMTRAYTIRGRQTGYDGVLSVGRVQTPVLGLIVRRDLEIEHFQPKDFFEVQAWVNPESKEEKTPEKSTALFSALWQPSKACEDYQDDDGRVLSKGLAENVVKRITNQPAEVTEYKDVREKETAPLPYSLSALQIDAAKRFGMSAQAVLDACQRLYETHRLITYPRSDCRYLPEEHFAERHNVLNAISTHCEAYQRLPNVISTEQRNRCWNDKKVEAHHAIIPTAKNRPVNLTQEERNIYSLIARQYLMQFCPDAEYRKSKITLNIAGGTFIAQARNLQTAGWKELLGKEDDTENQEPLLPIVKKGQILHCERGEVMSKKTQPPKPFTDATLLSAMTGIARFVQDKELKKILRETDGLGTEATRAGIIELLFKRSFLTKKGRNIHSTETGRILIQALPDIATQPDMTAHWESQLTDISQKQATYQQFMHNLNQMLPDLVRFVDLNALRQLSRIKMIKSDRVKPKSAVKKSSKSNGETD

SEQ ID NO: 3087 - protein, 113 aa, H. influenzae strain 86-028NP
MYQVLLFIYVVVAIALIGFILVQQGKGANAGASFGGGASGTMFGSAGAGNFLTRTSAILATAFFVIALVLGNMNSHKGNVQKGTFDDLSQAAEQVQQQQAAPAKDNKNSDIPQ

SEQ ID NO: 3088 - protein, 556 aa, H. influenzae strain 86-028NP
MKLFLTQSANVGDAKAYLLHEVFRAAAQKANVSIVETPAEADLVLVFGSVLPNNPALVGKKVFIIGEAIAMISPEVTLANALANGADYVAPKSAVSFTGVSGVKNIVAVTACPTGVAHTFMSAEAIEAYAKKQGWNVKVETRGQVGAGNEITAEEVAAADLVFVAADIDVPLDKFKGKPIYRTSTGLALKKTEQEFDKAFKEAKIFDGGNNAGTKEESREKKGVYKHLMTGVSHMLPLVVAGGLLIAISFMFSFNVIENTGVFQDLPNMLINIGSGVAFKLMIAVFAGYVAFSIADRPGLAVGLIAGMLASEAGAGILGGIIAGFLAGYVVKGLNVIIRLPASLTSLKPILILPLLGSMIVGLTMIYLINPPVAEIMKELSNWLTSMGEVNAIVLGVIIGAMMCIDMGGPVNKAAYTFSVGLIASQVYTPMAAAMAAGMVPPIGMTVATWIARNKFTVSQRDAGKASFVLGLCFISEGALPFVAADPIRVIISSVIGGAVAGAISMGLNITLQAPHGGLFVIPFVSEPLKYLGAIAIGALSTGVVYAIIKSKNNAE

SEQ ID NO: 3089 - protein, 313 aa, H. influenzae strain 86-028NP
MASVVTITLNAAYDLVGRLNRIQLGEVNTVETLGLFPAGKGINVAKVLKDLGVNVAVGGFLGKDNSADFEQMFNQHGLKDKFHRVNGKTRINVKITETEADVTDLNFLGYQISPQIWQQFVTDSLAYCLDYDIVAVCGSLPRGVSPELFADWLNQLHQAGVKVVLDSSNAALTAGLKAKPWLVKPNHRELEAWVGHSLNSLEEIIAAAQQLKAEGIENVIISMGAKGSLWINNEGVLKAEPAKCENVVSTVGAGDSMVAGLIYGFEKGLSKTETLAFATAVSAFAVSQSNVGVSDLSLLDPILEKVQITMIEG

SEQ ID NO: 3090 - protein, 499 aa, H. influenzae strain 86-028NP
MLELSESNIHLNANAIDKQQAIEMAASALVQAGNVENGYLQGMLARELQTSTFLGNGIAIPHGTLDTRLMVKKTGVQVFQFPQGIEWGEGNIAYVVIGIAARSDEHLSLLRQLTHVLSDEDTAAKLAKITDVAEFCAILMGETIDPFEIPAANISLDVNTQSLLTLVAINAGQLQVQSAVENRFISEVINNAALPLGKGLWVTDSVVGNVKNALAFSRAKTIFSHNGKAVKGVITVSAVGDQINPTLARLLDDDVQTTLLNGNSTEILTALLGSSSDVETQSVEGAVVGTFTIRNEHGLHARPSANLVNEVKKFTSKITMQNLTRESEVVSAKSLMKIVALGVTQGHRLRFVAEGEDAKQAIESLGKAIANGLGENVSVVPPSEPDTIEIMGDQIHTPAVTEDDNLPANAIEAVFVIKNEQGLHARPSAILVNEVKKYNASVAVQNLDRNSQLVSAKSLMKIVALGVVKGTRLRFVATGEEAQQAIDGISAVIESGLGE

SEQ ID NO: 3091 - protein, 178 aa, H. influenzae strain 86-028NP
MTMFKKISVLFFTLILAGCSSWSSVTNHIPFMGNDKKVIDLDKDKIDQKSYAAAYEATVATYKGRVNENFFVDNFASGANDWYLGRILVPVKQIQDKLYTGGHDSDVYAYYSGVLHAEALQANLKRLSANCWEKVDSQSMAQGIYDAMRDLQKGEARGENDEYIVQGSEALLKACTSK

SEQ ID NO: 3092 - protein, 92 aa, H. influenzae strain 86-028NP
MYAIAFDLVVKDTQDYHPKGVQEAYTDIGAVLAKFGFVRTQGSLYTNMNEDMANLFQAMNALKQLAWISQSVRDIRAFRIEQWSDFTDFIRN

SEQ ID NO: 3093 - protein, 63 aa, H. influenzae strain 86-028NP
MELRQQIPTGCIKQFGQFGVPYVVGEVAEFLPDGDVLVNITLLQSGEKDIYRLSYLLEDPEAE

SEQ ID NO: 3094 - protein, 432 aa, H. influenzae strain 86-028NP
MIMELFHTILAIVALILSSAVVSSAEISLASSRKLKLQSLANKGDVRALQVLKLQEHPGRFITVVQILLNMVAILGGGIGESALSPYIADILNRSFEGSWIEPTASTIAFILVTCLFILFADLIPKRIAITYPEMVALSVVGIMNFSMYVFKPLVWFFDTIANVFFRLFRISTVREDGMTSEDIFAVVEAGAEAGVLKTQEHYLIENIFDMQARTVTSTMTTRENIVYLDRTFSRQEVMDTLSRDSHSKIVICDNGLDKILGYIESHTLLTMYLQNENVVLTDPKLLRKALFVPDTLSLYEVLELFKSTGEDFAIIVNEYALVVGIVTLNDVMSIVMGELVSNEEEYIVSRDENSWLIDGATPLKEVTRVLDIAYFPDEENYETISGFMMYMLRKIPKKTDSVVYGKYKFEVIDTENFKIDQILVSLVKEQE

SEQ ID NO: 3095 - protein, 174 aa, H. influenzae strain 86-028NP
MRKFFKYFLFIVVFLFHGFMFSVVNYVFPHYDVTRVTGVEVKRVDKDGPITKSNPADGPTRDVYYINTQNDDGKIMVYRNEDTRWGFPFYFKFGSANLQAEAQALGNDNKLVQIKYYGWRITMMDEYRNATSIKEITADDTPSNPIVSWILYVFLLATLFLSIQFIRGWFDSDK

SEQ ID NO: 3096 - protein, 260 aa, H. influenzae strain 86-028NP
MFIVDSHCHLDALDYENLHKNISDVVEKARARDVKHLLAIGVTLSRFEQAYDSLREFNNVSLACGVHPLDFEEEPYDAERLLRLSQDPKVIAIGEIGLDYYYSADNKAAQQAVFGSQIDIANQLDKPVIIHTRSAGDDTIAMLREHHAEKCGGVIHCFTETMEFAKKALDLGFYISCSGIVTFKNAEAIREVIRYVPMDRLLVETDSPYLAPVPYRGKENQPAYTREVCEYVATLKGVSAEAFAQITTQNFERLFKIRVE

SEQ ID NO: 3097 - protein, 327 aa, H. influenzae strain 86-028NP
MTALYPWLMPIYHQIAQTFDEGLGHHAVLIKADSGLGVESLFNALAQKIMCVAQGDKPCGQCHSCHLMQAHSHPDYHELSPIDGKDIGVDQVRDINEIVAQHAQQNGNKVVYVQGAERLTEAAANALLKTLEEPRSNTYFLLQTDSSASLLATIYSRCQVWNLSVPNEQMAVDWLKSESAAENQEILTALAMNLGRPLLALETLQQGLIEQRKNFLRQFWVFYRRRSPLELLPLFDKERYVQQVDWILAFLSDCLKHKLEIDSHRQVADLGRGIEQFSDEQTALGLLQAIKIMQKVRSDLLTINGVNLELMLLDGLTRLVTEVFETQ

SEQ ID NO: 3098 - protein, 42 aa, H. influenzae strain 86-028NP
LVQIFSIYFLFIKSKRLLFAILSSQFENVYNCPRYLQKFQEK

SEQ ID NO: 3099 - protein, 707 aa, H. influenzae strain 86-028NP
MKLEASKQASKQASKQASKQASKQASKQASKQASKQASKQASKQKFKKSFIISLFFSILYTSPLLAVVDYTYDNSKLTNEQIERLKKLRDRNSEYWKKETYLLKSPPSNFPDIPVLFPKDSSVPFENIDNSKAISFYDQKYTEDYLVGFAQGFGVAKRNGDTEEPVRKYFKECLNTGNYNNDNCKANPLASSVSIKSDIFTPRPTIKNSHINSEILAVGNYTELMLAAQPSASSWAEHLYSDPGLSLTVQDNSHVIGQTIDLGFLQLTNSLWEPRWNSNIDYLVTENAEIRFNTKNESLLVEGYYAGGARFRFAYDLKDKAPETPVLTFEQNITGTSDIIFENPIDDLKSLDGHQIVKVNGTADKNAFRLSGKYRKGIYTLSLQQRLEGFFTKLQERDDIAIYAQQAQAANTLFALRLNDKNSDIFDRTLPRKGLWLRVIDGHSSQWVQGKTAPLEGYRKGVQLGGEVFTWQNESNQFSVGLMGGQAEQRSTFRNPDTDNLTTGNMKGLGAGVYATWHQLQDKQTGAYVDSWAQYQRFRHRINTEDGTERFTSKGITASIEAGYNALLAEHLTGKGTQIRFYLQPQAQLTYLGVNGKFSDSENSQVNLLGSRQLQSRVGVQAKAQFLLNKNIVIQPFAAVNTLYHSKPFGVEIDGERRVINNKTAIESQFGIAVKIKSHLTLQATFNRQTGKHHHAKQGALNLQWTF

SEQ ID NO: 3100 - protein, 219 aa, H. influenzae strain 86-028NP
MPNKSAEENMKGKFIVIEGLEGAGKSSAHQSVVQVLHELGIQDVVFTREPGGTPLAEKLRHLIKHETEEPVTDKAELLMLYAARIQLVDNIIKPALMQGKWVVGDRHDMSSQAYQGGGRQLDPHFMLTLKETVLGDFEPDLTIYLDIDPIVGLARARGRGELDRIEQMDLDFFHRTRARYLALVKENPKAVVINAEQSIELVQADIERAVKNWWKSNEK

SEQ ID NO: 3101 - protein, 347 aa, H. influenzae strain 86-028NP
MKKFLIAILLLIFILAGVASFAYYKMTEFVKTPVNVQADQLLTIERGTTGLKLAALFEQEKLIDDGKLLPYLLKLKPELNKIKAGTYSLENVKTVQDLLDLLNSGKEVQFNVKWIEGKTFKDWRKDLENAPHLVQTLKDKSNEEIFTLLDLPDIGQNLELKNVEGWLYPDTYNYTPKSTDLELLKRSAERMKKALNKAWNERDEDLPLANPYEMLILASIVEKETGIANERAKVASVFINRLKAKMKLQTDPTVIYGMGENYSGNIRKKDLETPTPYNTYVIDGLPPTPIAMPSESSLQAVAKPEKTDFYYFVADGSGGHKFTRNLNEHNKAVQEYLRWYRSQKNAK

SEQ ID NO: 3102 - protein, 313 aa, H. influenzae strain 86-028NP
MKMKKFILKSFLLATLGCVAFTSMAQAEERVVATVDGIPILESQVRANMGKKGDRQSALDKIIDDLLVQKAIQESGVKIDPREIDRVVEDTAARNGLTYGQFLDALDYQGISLNTFRQQIANQMVMGAVRNKAIQESIDVTREEVVALGQKMLDEAKSQGTAQKVTGKEYEVRHILLKLNPLLNDAQAKKQLAKIRSDIIAGKTTFADAALKYSKDYLSGANGGSLGYAFPETYAPQFAQTVMKSKQGVISAPFKTEFGWHILEVTGVRDGDLTAEAYTQKAYERLVNTQLQDATNDWVKALRKRANIQYFNK

SEQ ID NO: 3103 - protein, 179 aa, H. influenzae strain 86-028NP
MEKIIIDHDRFLRTISRISHEIIEKHQTLDDLVIVGIKRRGAEIAELLQRRVEELSGINLPSMELDITFYRDDLTLVDQEDKMPVYSGSSQYLNIQDKTVILVDDVLFTGRTIRAAMDALTDFGRAAKIELVIFVDRGHRELPIRADYVGKNVPTSRDELVQVRTEKQDGCYEVAILGK

SEQ ID NO: 3104 - protein, 263 aa, H. influenzae strain 86-028NP
MHYSIQDFIQLIAQLRNPNGGCPWDLKQNYESMIPCLTEETYEVIEAIEKKDIPNLREELGDLLLQVVFFSQLATEDKYFTFDDVLQDIAEKIVRRHPHVFGDAKAGDETEALSRWNEMKAKEKQGKSEETSILDNVPRALPSLTRAAKLQKRCSKVGFDWEEISPVFDKVREELEEVQAEINRTSIEQNKVEEEIGDLLFATVNLARHLKCDPEDALRKANLKFERRFRAVEQAVQQQGKQVNNVPLIELDLLWDEVKKQEN

SEQ ID NO: 3105 - protein, 291 aa, H. influenzae strain 86-028NP
MSTKNHFIFPTYVQMYPYSKDRPFLKQVREKLRYYGYKWLYQKQCHQLVDFLNTETQWQSLFTQDYYRTNTILTTFCDKRFSASERLTAITENLRLAEEKMGRSLCQQLLDQQHIVLTQLTEDLRLSLSINHIDPFEGYFSINIRNQNNERVYDASFTFLSPNKLLIASIQGPSSDNAQELVKQATKALHGMRPMFMLVNAFKMLAEKWQCELVGIPHKAQGKYRLSARSKILFNYDEFWQENQGEYRHNYWQLPLHIERKQLEDIASKKRSMYRKRYEMLDQMALDIQQL

SEQ ID NO: 3106 - protein, 803 aa, H. influenzae strain 86-028NP
MAKNTQRTMPVLPLRDVVVFPYMVMPLFVGRVKSINALEEAMNDDKQILLVSQREADLEEPTPEDLFDVGTIANIIQLLKLPDGTVKVLVEGQNRAKINSLEDGEKCFSAQITPIETTYGDEQELVVAKSAVLSEFENYLTLNKKVPTDILNALQRIDDVDRLADTMAAHLPVSIRHKQNALELANVQERLEYLLGMMESEADILQVEKRIRGRVKKQMEKSQRNYYLNEQIKAIRKEMDGGENEDTIDEVEQLHQKVEAAGMPADVRDKVENELQKLKMMSAMSSEATVIRSYIEWMIQVPWHQRSKVKKDIVKAQQVLDTDHYGLDRVKERILEYLAVQARLNKVKGPILCLVGPPGVGKTSLGQSIANATGRKYVRMALGGVRDEAEIRGHRKTYIGALPGKLIQKMAKVGVKNPLFLLDEIDKMASDMRGDPASALLEVLDPEQNTTFNDHYLEVDYDLSDVMFVATSNSMNIPGPLLDRMEVIRLSGYTEDEKLNIAMRHLLAKQIERNGLKKGELTVKESAILDIIRYYTREAGVRGLEREISKICRKAVKNLLVNPKLKSITVNSDNLHDYLGVKRFEFGKADTQNRIGEVTGLAWTEVGGDLLTIETASVVGKGKLSFTGSLGDVMKESIQAAMTVVRARADKLGINAEFHEKRDIHIHVPDGATPKDGPSAGIAMCTALISCLTGNPVRADVAMTGEISLRGKVLPIGGLKEKLLAAHRGGIKTVLIPKENVKDLEKIPENVKQNLAIHAVETIDEVLGFALENPPEGIEFVKVKAKPKAPRRKVTSKSERAVN

SEQ ID NO: 3107 - protein, 383 aa, H. influenzae strain 86-028NP
MLKLPPLSLYIHIPWCVQKCPYCDFNSHAQKGDIPEQDYIYHLLQDLQADLQRFKDSIQQRKLHSIFIGGGTPSLFSAESIAYLLKEIKKQIDFEDNIEITLEANPGTVEAERFKGYVSAGIMRISMGIQSFNDDKLQRLGRIHNAAEAKSAVNLAKVSGLKSFNLDLMHGLPNQTLEEALDDLRQAIELSPPHISWYQLTIEPNTMFAYRPPKLPDDDALWDIFEQGHQLLTMAGYQQYETSAYAKAGFQCKHNLNYWRFGDYLAIGCGAHGKLTFPTGEITRFSKTKHPKGYLRGEYLYEEKNVPEIDRPFEFFMNRFRLLEAVPKQEFEDYTGLSQSAVKNQIDFAIQQNYIVENADSWQITEHGKLFLNELLELFLTEE

SEQ ID NO: 3108 - protein, 219 aa, H. influenzae strain 86-028NP
MNQLEMKKLAAQAALEYVTADTIVGVGSGSTVNCFIEALGTIKNKIQGVVAASKASEELLRKQGIEVFNANDVSSLDIYVDGADEINPQKMMIKGGGAALTREKIVAALAKKFICIVDSSKQVDVLGSTFPLPVEVIPMARSQVGRKLVALGGAPEYREGVVTDNGNVILDVHNFSILNPVEMEKELNNVAGVVTNGIFALRGADVVIVGTPEGAKIID

SEQ ID NO: 3109 - protein, 410 aa, H. influenzae strain 86-028NP
MTNKVSLDKSKIKFVLFEGVHQSALDTLHAAGYSNIDYYKKALDGDELKEAIKDAHFIGLRSRTHLTAEMIEAAPKLIAVGCFCIGTNQVDLNAAKARGIPVFNAPFSNTRSVAELVLGEILLLMRNVPQANAEVHRGVWNKSATGSYEVRGKKLGIIGYGHIGSQLSIIAESLGMDVYFYDIENKLPLGNAKQVRSLEELLSSCDVVSLHVPELPSTKNLMNATRIAQLKQGAILINAARGTVVDIDALAQALKDGKLQGAAIDVFPVEPASINEEFVSPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 3110 - protein, 280 aa, H. influenzae strain 86-028NP
MSQFISLTQYQLIEVQGADVEKYLQGQLTSDVVRLASGATTLTAHCDPKGKMNAIYRLFKVSSEQVFLLVKKDILPSALDALKKYAVFSKVSFDLRDWQIIGVIGEKCGKITPHFSLEIDGQRSILLNETELPVNFNGDEKIWEVADIQAGLPNLSPQTQNEFIPQALNLQAVEQAISFTKGCYIGQETVARAKYRGANKRAMFIFKAQTQQEVEIGSEIEMQLEANWRKTGTITSAVNLDGILWLQVVMNNDMDSEQQFRLPSNEILLERVQLPYSITE

SEQ ID NO: 3111 - protein, 287 aa, H. influenzae strain 86-028NP
MIYSMTAFARLEVKKDWGDAVWEIRSVNQRYLENFFRLPEQFRGLENTLREKLRQSLTRGKIECSLRIETKKQTNAELNLNKELANQVIQSLQWIKTQAGEGEINLTDVLRYPGVVEAQEQDLDAISQDLLTAFDDLLTDFIAMRGREGEKLNDIIQQRLDAIAVEADKVRSQMPAVLQWQRERLLQRFEDAQLNLDPQRVEQEMILLAQRVDVAEELDRLQMHVKETTNILKKGGAVGRKLDFMMQELNRESNTLASKSINADITASAVELKVLIEQMREQIQNLE

SEQ ID NO: 3112 - protein, 303 aa, H. influenzae strain 86-028NP
MTNTTMQPNRLRIALQKKGRLSQDCAILLKQCGVKINWNEQRLIAYAENLPIEILRVRDDDIPGLIFDGVVDLGIIGENVLEEEELGRRAANETVTYKKLRQLDFGDCRLSLAVDRDCHYENVKDLANRRIATSYPHLLKRYMNENGVSFKSCLLNGSVEVAPSAGIAYAICDLVSSGATLEANGLKEVDVIYRSKACLIQRAEPLESTKQALVDKLLTRIQGVQQAAESKYIMLHAPKEKLEKITALLPGVENPTILPLASDTTRVAMHVVSQENLFWETMEQLKEAGASSILVLPIEKMME

SEQ ID NO: 3113 - protein, 427 aa, H. influenzae strain 86-028NP
MQTIIWNHLSETEKRKVIMRPVQQNGENIQQAVNAIRENVAYNGDRALFELCEKFDGVKLDKLIVSADEIQAASSRISVKLRNAIEQAKTNIEAFHKAQQNQEIDLEIQEGVRCQVVTRPISCVGLYIPGGSAPLFSTVLMLAIPAKIAGCKKIVLCSPPPISDEILYTAHLCGVETIYAIGGAQAVFAMAQGTESVAKVDKIFGPGNAFVTEAKRQVAQNSTAIDMPAGPSEVLVIADESADPEFVASDLLSQAEHGADSQVILVATCETLAKETALAIERQLALLPRAETARKALNHSRIFIAESLEQAVEISNEYAPEHLIVQTKNARKLLPYLDNAGSIFLGAYSPESMGDYASGTNHVLPTYGYTKTYSSLGLADFSKRMTVQELTPKGFKNLAETVEVMAEAEQLAAHKMAVSVRLAKLNI

SEQ ID NO: 3114 - protein, 367 aa, H. influenzae strain 86-028NP
MNDYNSHILQWKKTIMTITTLSRQNIQALTPYQSARKLGGNGTIWLNANEYPTSPEFQLSGKDLNRYPEPQPQRVVQAYANYAGVSTENVLVTRGGDEGIELIIHTFCEPKQDAILFCPPTYGMYAVSAETAGVLSKSVPLTDDFQLNLPEIKNHLNDVKVVFVCSPNNPTGNLLKQSDILDLLQITAGKAIVVVDEAYIEFCPEASVINLLKNYPHLAIIRTLSKAFALAGLRCGFVLANPELIDILSKVIAPYPIPVPSADLAEQALRPANIATVQALTQELLSNRQWLAKALLVLHQVEKVYESEANYLLIKCQNGQAVFKALWEQGIILRDQNKTLHLQNCIRITVGTRNECEKVVEAIKEVK

SEQ ID NO: 3115 - protein, 362 aa, H. influenzae strain 86-028NP; identical to SEQ ID NO: 616

SEQ ID NO: 3116 - protein, 199 aa, H. influenzae strain 86-028NP
MTNITIIDTGCANLSSVKFAFDRLGYNTEITFDLNKIKSADKLILPGVGTANAAMYNLQERQLIETIQNLTQPVLGICLGMQLMTEFSEEGNVPTLNLISGKTNRIPDTGLPLPQMGWNRVQFVKNCPLFDGIVQNSHFYFVHSYAVSPNEHSVAISNYGVNFSAAIAKENFYGVQFHPERSGKNGALLLKNFVEKVPF

SEQ ID NO: 3117 - protein, 249 aa, H. influenzae strain 86-028NP
MKQSIIIPALDLINGQVVRLHQGDYAKQTTYSDNPIKQFDNYVRQGAKQLHLVDLTGAKNPQSRQTALIGKIVEATQCKVQVGGGIRTEQDVADLLAVGANRVVIGSTAVTHRSMVKNWFIKYGAEKFVLALDVNINASGQKIVAISGWQEESGVLLETLIEDFQTVGLQQVLCTDISRDGTLTGSNIGLYQEICEKYPPIQFQSSGGIGSLADIEALKGTGVSGVIVGRALLEGKFTLSEAIKCWQNG

SEQ ID NO: 3118 - protein, 258 aa, H. influenzae strain 86-028NP
MLAKRIIPCLDVRDGQVVKGVQFRNHEIIGDIVPLAQRYAQEGADELVFYDITASSDGRTVDKSWVERIAQVIDIPFCVAGGIKTIEDAEKLFAFGADKISINSPALADPTLISRLADRFGVQAIVVGIDSWFEQETGKYWVNQYTGDETRTRQTHWQLLDWVKEVQQCGAGEIVLNMMNQDGLRNGYDLAQLKLVRGVCRVPLIASGGAGKMVHFRDAFIEAKVDGALAASVFHKQIIEIGELKSYLVQSAIEIRSE

SEQ ID NO: 3119 - protein, 221 aa, H. influenzae strain 86-028NP
MNITKIDWQKVNGLLPVIIQNISTREVLMLGYMNEEALTKTIKERKVTFFSRTKQRLWTKGEISGNFLNVEEMSLDCDNDTLLILVDPIGATCHTGEYSCFHQFTSPQSENKKQQFANWAWFIKLEQHLKEKKNADPSNSYTATLHAKGTKKIAQKVGEEGVETALAAVAQDKAEVISEATDLVYHLTVLLHNQDLQWYEIIAKLQERHQGIGLHPEGGNK

SEQ ID NO: 3120 - protein, 50 aa, H. influenzae strain 86-028NP
MVIKCIDKQQNLGNIILFLLLKQQYSKEDSKKFTIYKFYLQTVNYTIQLS

SEQ ID NO: 3121 - protein, 400 aa, H. influenzae strain 86-028NP
MNKTVGSTLLVAGTMIGAGMLAMPLTSAGIGFGFTLVLLLGLWALLTFSALLFVELYQTAESDAGIGTLAEQYFGKTGRIIATAVLIIFLYALIAAYISGGGSLLKDLLPESFGDKVSVLLFTVIFGSFIVIGTHSVDKINRVLFFVMLAAFAVVLSLMLPEIKFDNLMATPIDKALIISASPVFFTAFGFHGSIPSLNKYLDGNVKALRFSILVGSAITLCAYILWQLSTHGLLTQNEFLQILKEDATLNGLVKATFAITGSNVIASAVKLFSTLALITSFLGVGLGLLECIEDLLKRSFNVTAGRISLGLLTFIPPLVFALFYPEGFILALGYAGQMFAFYAVVLPVSLVWKARRAHANLPYKVWGGNLTLIIVLVLGVIITSIPFAIRAGYLPFVVG

SEQ ID NO: 3122 - protein, 142 aa, H. influenzae strain 86-028NP
MATFNLTIVSAEQKIFEGEVKQIQVTGVEGELGILPGHTPLLTAIKPGIVKFTLKDGNEEVIYVSGGFLEVQPNIVTVLADIAIRGSELDADRIHEAKRKAEENIVSRGSDADHDLLVAKLSKELAKLRAYELTEKLLKTRR

SEQ ID NO: 3123 - protein, 457 aa, H. influenzae strain 86-028NP
MSAGKIVQIIGAVIDVEFPQDAVPKVYDALKVESGLTLEVQQQLGGGVVRCIALGTSDGLKRGLKVENTNNPIQVPVGTKTLGRIMNVLGEPIDEQGAIGEEERWAIHRSAPSYEEQSNSTELLETGIKVIDLICPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRQIASLGIYPAVDPLDSTSRQLDPLVVGQEHYDVARGVQGILQRYKELKDIIAILGMDELSEEDKLVVARARKIERFLSQPFFVAEVFTGSPGKYVTLKDTIRGFKGILDGEYDHIPEQAFYMVGSIDEVLEKAKNM

SEQ ID NO: 3124 - protein, 289 aa, H. influenzae strain 86-028NP
MAGAKEIKTKIASVQSTQKITKAMEMVATSKMRKTQDRMAASRPYSETIRNVISHVSKASIGYKHPFLVECEVKKIGILVISTDRGMCGGLNVNLFKTTLNQIKNWKEQNISTDLGLIGSKGISFFRSFGFNIKGQLSGLGDTPALEELIGVANTMFDAYRNGEIDAVYIAYNKFVNTMSQKPVVQQLVPLPESKDDHLNERQQTWDYLYEPEPKALLDSLLVRYLESQIYQAVVDNLASEQAARMVAMKAATDNAGNLINDLRLVYNKARQASITNELNEIVAGAAAI

SEQ ID NO: 3125 - protein, 513 aa, H. influenzae strain 86-028NP
MQLNSTEISELIKKRIAQFDVVSEARNTGTIVSVSDGIIRIHGLSDVMQGEMIALPGNRYAMALNLERDSVGAVVMGPYADLAEGMEVQCTGRILEVPVGSGLLGRVVNTLGQPIDGKGEIENDDFSPVEVIAPGVIDRRSVDQPVQTGYKAVDSMVPIGRGQRELIIGDRQTGKTALAIDAIINQRNSGIKCIYVAIGQKASTIANVVRKLEEHGALANTIVVAASASESAALQYLAPYAGCAMGEYFRDRGEDALIVYDDLSKQAVAYRQISLLLRRPPGREAYPGDVFYLHSRLLERASRVNEDYVEKFTKGEVKGKTGSLTALPIIETQAGDVSAFVPTNVISITDGQIFLESNLFNSGIRPAVNPGISVSRVGGSAQTKVIKKLAGGIRTALAQYRELAAFAQFASDLDDATRKQLSHGEKVTELLKQKQFAPLSVAEQAVILFAVEFGYLDDVELSKIASFETALLDYSNRNHAEFMQELNKTGNYNDEIKDTLKSILDGFKANSAW

SEQ ID NO: 3126 - protein, 177 aa, H. influenzae strain 86-028NP
MSELTTIARPYAKAAFDFAIEQSAVEKWTEMLGFAAAVAEDETVKAYLSSSLSAQKLADTVISICGEQLDQYGQNLIRLMAENKRLSAIPAVFEEFKHHVEEHQAIAEVEVTSAQPLNATQIEKIAAAMEKRLARKVKLNCNVDNALIAGVIVRTEDFVIDGSSRGQLTRLANELQL

SEQ ID NO: 3127 - protein, 156 aa, H. influenzae strain 86-028NP
VNLNATLIGQLIAFALFVWFCMKFVWPPIINAIETRQSQIANALASAEAAKKEQADTKNLVEQELSAAKLQAQDILDAANKRRNEVLDEVKAEAEELKAKIIAQGYAEVEAERKRVQEELRLKVASLAVAGAEKIVGRSIDEAANNDIIDKLVAEL

SEQ ID NO: 3128 - protein, 84 aa, H. influenzae strain 86-028NP
METVITATIIGASILLAFAALGTAIGFAILGGKFLESSARQPELASSLQTKMFIVAGLLDAIAMIAVGISLLFIFANPFIGLLN

SEQ ID NO: 3129 - protein, 262 aa, H. influenzae strain 86-028NP
MSGQTTSEYISHHLSFLKTGDGFWNVHIDTLFFSILAAVIFLFVFSRVGKKATTGVPGKMQCLVEIVVEWVNGIVKENFHGPRNVVAPLALTIFCWVFIMNAIDLIPVDFLPQFAGLFGIHYLRAVPTADISATLGMSICVFFLILFYTIKSKGFKGLVKEYTLHPFNHWAFIPVNFILETVTLLAKPISLAFRLFGNMYAGELIFILIAVMYSANMAIAALGIPLHLAWAIFHILVITLQAFIFMMLTVVYLSIAYNKADH

SEQ ID NO: 3130 - protein, 124 aa, H. influenzae strain 86-028NP
MSRILSHAKKNYRKAIIIESLLLVVFYLLIYGWQRQSAVDFSYGFLSAFLPFCTFIFIIFYRKQNFSTKLTALYRAEAIKFILTMVFIIIAIKWLFVINFIAFFVGFLLALVLNNIIPLILNKI

SEQ ID NO: 3131 - protein, 203 aa, H. influenzae strain 86-028NP
MKAKLVSLLAQANIKISDQQIQQLINLVNLLNKWNKAYNLTSVRDPQEMLVKHILDSLVVSPYLQGDRFIDVGTGPGLPGLPLAIINPSKQFVLLDSLGKRISFIRNAIRELRLTNVTPVLSRVEEYQPEDKFDGVLSRAFASLKDMTDWCHHLPKENGYFYALKGIYQEDEINELNKKYTIQKVIELSVPELIGERHLIVLR

SEQ ID NO: 3132 - protein, 125 aa, H. influenzae strain 86-028NP
MRLFKQLERWKTRRQINQSIIDVVFRLRDRLAHYWQADVNTPQVDFMLLHIACSLGRIERGGCVSSLYSEMLEEMQSAVIFPQVLAIHQDLLKLMPFSIPEAEQTYFLANIHSLVLEQKQLKPLK

SEQ ID NO: 3133 - protein, 200 aa, H. influenzae strain 86-028NP
MLDYEIFNPYEGLIFDMDGTLIDTMPVHAQAWTMVGKKFGYEFDFQIMYNFGGATVRTIAGEMMKAANMPLDRIEDVLAAKRELSYQLIPTQSKLLPTFEIVKSFHQKKPIALGSGSHRKIIDMLMDKLAIAPYFNAIVSADDVKEHKPHPETFLRCAELIQANPSRCIVFEDADLGVQAGLSAGMDVFDVRTREIISPR

SEQ ID NO: 3134 - protein, 157 aa, H. influenzae strain 86-028NP
MDIFSFFSADFWQANSLCFMFISAFLSATVLPGNSEVIFVALAVPKLMLGSLFNADILALILIATAGNSLGSLTTYGIGRWMPKFDPKNYRTLWAINQLRRYGAIVLLLSWLPVVGDLFCAIAGWLRLNFVTSSLFIFLGKMVRYVALLFLSTPFLL

SEQ ID NO: 3135 - protein, 167 aa, H. influenzae strain 86-028NP
MPLLDSFKVDHTKMNAPAVRIAKTMCTPKGDNITVFDLRFCIPNKEILSPKGIHTLEHLFAGFMRDHLNGDSIEIIDISPMGCRTGFYMSLIGTPNEQEVSEAWLASMQDVLGVQDQASIPELNIYQCGSYTEHSLEDAHEIAKNVIARGIGVNKNEDLSLDNSLLK

SEQ ID NO: 3136 - protein, 235 aa, H. influenzae strain 86-028NP
MKNGIKLSVIALLTAAAVPAMAGKTEPYTQSGTNAREMLQEQAIHWISVDQIKQSLEGKAPINVSFDIDDTVLFSSPCFYHGQQKFSPGKHDYLKNQDFWNEVNAGCDKYSIPKQIAIDLINMHQARGDQVYFFTGRTAGKVDGVTPILEKTFNIKNMHPVEFMGSRERTTKYNKTPAIISHKVSIHYGDSDDDVLAAKEAGVRGIRLMRAANSTYQPMPTLGGYGEEVLINSSY

SEQ ID NO: 3137 - protein, 175 aa, H. influenzae strain 86-028NP
MTTIVSVRRNGQVVVGGDGQVSLGNTVMKGNARKVRRLYNGKVLAGFAGGTADAFTLFELFERKLEMHQGHLLKSAVELAKDWRTDRALRKLEAMLIVADEKESLIITGIGDVVQPEEDQILAIGSGGNYALSAARALVENTELSAREIVEKSLKIAGDVCVFTNTNFTIEELPN

SEQ ID NO: 3138 - protein, 444 aa, H. influenzae strain 86-028NP
MSEMTPREIVSELDQHIIGQADAKRAVAIALRNRWRRMQLQEPLRHEVTPKNILMIGPTGVGKTEIARRLAKLANAPFIKVEATKFTEVGYVGKEVDSIIRDLTDSAMKLVRQQEIAKNRARAEDAAEERILDALLPPAKNQWGEVENHDSHSSTRQAFRKKLREGQLDDKEIEIDVSAGVSMGVEIMAPPGMEEMTNQLQSLFQNLGSDKTKKRKMKIKDALKTLIDDEAAKLINPEELKQKAIDAVEQNGIVFIDEIDKICKKGEYSGADVSREGVQRDLLPLVEGSTVSTKHGMVKTDHILFIASGAFQVARPSDLIPELQGRLPIRVELTALSAADFERILTEPHASLTEQYKALMATEGVNIEFTTEAVKKIAEAAFRVNEKTENIGARRLHTVMERLMDKISFSASDMNGQTVNIDAAYVADALGEVVENEDLSRFIL

SEQ ID NO: 3139 - protein, 350 aa, H. influenzae strain 86-028NP
LKKFFAHSLKNLFLSTTALFAASAFANNKLYVYNWTDYVPSDLVAQFSKETGIEVIYSTFESNEEMYAKLKLTQNTGSSYDLVFPSSYYINKMIKEKMLQPIDQSKLTNIHQIPKHLLNKEFDPENKYSLPYVYGLTGIEVNADEIDPKTITSWADLWKPEFKGKVLMTSDAREVFHVALLLDGKSPNTTNEEDIKTAYERLEKLLPNVATFNSDSPEVPYVQGEVAIGMIWNGSAYLAQKENQSLQFVYPKEGAIFWMDNYAIPNSAQNVEGAYKFIDFLLRPENAKIVIERMGFSMPNNGAKTLLSAEVANDPKLFPPAEEVEKGIMQGDVGEAVDIYEKYWSKLKTN

SEQ ID NO: 3140 - protein, 431 aa, H. influenzae strain 86-028NP
MLNFAYQEHVRSYYFDSRNQDFQFPPLTQIEHADVCVIGAGFFGLSAALELAEKGKKVIVLEGARVGFGASGRSGGQAINGFEEGIDEYVKQVGEDKAHKLWNMSLETIDIIDERIEKYSIQCDWKKGYATLALNERRMDDLIEMEKESHKNFGYQNMQLWDKTKLKQHLGSDIYVGGLFDSNSGHLHPLNYCLGLAKACVDLGVQIFEQSPVVDMVEKNGCIEVKTAKSAVISQDVILATNAYIDALPKSIHHGINRKILPVESFIIATEPLSQAVADSVINNGMSVCDNNLLLDYYRLSADNRLLFGSDSSSEKDMVAIMRKNMLCVFPQLENVKIDYGWAGPIDMTLNSTPHFGRISPHIYFAHGYSGHGVALTGLAGRIVAEAILGDDERLSIFEGLKVPSVYGGRIIKDLATKIGVRYYKFLDKYR

SEQ ID NO: 3141 - protein, 480 aa, H. influenzae strain 86-028NP
MSENLLLFSLLAVVIILILLLILRQQKYTHLHQELSKTTQDYNQLASKFDELSSIKNQFEQQTIKVQTENQGLQYRLTERDEQIHHLTQERQNLTEKLTALSQELTGLQTTLTEKEKYFSAQQQNFEQSKLQLSVEFQNLANRILDEKSRSFSQSNQTALETLLKPFREQIEGFQKRVNEIHSESVKGNAGLEAEIKKVLEIGLNMSQEASNLTSALKGEKKTLGNWGEVQLERALQLAGLEENVHYRAQAHFKDEQGGRNYPDFVLNLPDEKHLIIDSKMSLVAYESAVNSEDDFERERLLKEHISALKTHINDLHKKDYSNLIGMRSPNFVLMFIAVEPAYIEALKADPALFNYGYERNVIMVSHTTLMPILRTVANLWRIERGNAEAKEIAEKAGEIYNQICLVAERLSKLGNTLSTVSNQYNSTVTALVGQQGLVGKVERFKTLSAKANKTMPDVDLLNNQLDLARLNVLNQENLQ

SEQ ID NO: 3142 - protein, 139 aa, H. influenzae strain 86-028NP
MKKTMLLNAQLSRCIASVGHTESLTICDAGLPIPLSVERIDLALTAGVPSFLQTLNVVTNEMYVERVVIAEEIKEKNPEILTALLTQLQQLESHQGNQIQVEFVSHETFKKFTLESKAIVRTGECSPYANVILYSGVPF

SEQ ID NO: 3143 - protein, 493 aa, H. influenzae strain 86-028NP
METLLKISGVDKSFPGVKALNNACLSVYAGRVMALMGENGAGKSTLMKVLTGIYSKDAGTIEYLNRSVNFNGPKASQEAGISIIHQELNLVGNLTIAENIFLGREFKTSWGAINWQKMHQEADKLLARLGVTHSSKQLCAELSIGEQQMVEIAKALSFESKVIIMDEPTDALTDTETEALFNVIRELKAENRGIVYISHRLKEIFQICDDVTVLRDGQFIGERIVAEITEDDLIEMMVGRRLDEQYPHLSQEKGECVLDVKNVSGSGIDDVSFKLHAGEIVGVSGLMGAGRTELGKLLYGALPKTAGKVRLKNQEIENLSPQDGLDNGIVYISEDRKGDGLVLGMSVKENMSLTSLDHFSQKGSIRHQAEKMTVDDFILMFNIKTPNRDQQVGLLSGGNQQKVAIARGLMTRPNVLILDEPTRGVDVGAKKEIYQLINEFKKEGLSILMISSDMPEVLGMSDRVLVMREGKISAEFSRKDATQEKLLAAAIGK

SEQ ID NO: 3144 - protein, 323 aa, H. influenzae strain 86-028NP; identical to SEQ ID NO: 620

SEQ ID NO: 3145 - protein, 292 aa, H. influenzae strain 86-028NP
MKKLTALTSAVLLGLAVSGSASAQDTIALAVSTLDNPFFVTLKDGAQKKADELGYKLVVLDSQNDPAKELANVEDLTVRGAKILLINPTDSEAVGNAVAIANRKHIPVITLDRGAAKGNVVSHIASDNIAGGKMAGDFIAQKLGDNAKVIQLEGIAGTSAARERGEGFKQAIDAHKFNVLASQPADFDRTKGLNVTENLLASKGDVQAIFAQNDEMALGALRAVKAANKKVLIVGFDGTDDGVKAVKSGKMAATIAQQPELIGSLGVVTADKILKGEKVEAKIPVDLKVISE

SEQ ID NO: 3146 - protein, 306 aa, H. influenzae strain 86-028NP
MKKTLTVLGSINADHVISVPYFAKPGETLTGQNYQIAYGGKGANQAVAAARLGAKVAFISCIGSDSIGKTMKNAFEQEGIDTTHINTVSQEMTGMAFIQVAKSSENSIVLASGANAHLGEMVVRQSEAQIAQSDCLLMQLETPLSGVELAAQIAKKNGVKVVLNPAPAQILSDELLSLIDIITPNETEAEILTGVAVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 3147 - protein, 332 aa, H. influenzae strain 86-028NP
MATMKDIARLAQVSTSTVSHVINGSRFVSDEIREKVMRIVAELNYTPSAVARSLKVRETKTIGLLVTATNNPFFAEVMAGVEQYCQKNQYNLIIATTGGDAKRLQQNLQTLMHKQVDGLLLMCGDSRFQADIELAISLPLVVMDWWFTELNADKILENSALGGYLATKALIDAGHRKIGIITGNLKKSVAQNRLQGYKNALSEAKIALNPHWIVESHFDFEGGVLGIQSLLTQSSRPTAVFCCSDTIAVGAYQAIQQQGLRIPQDLSIMGYDDIELARYLSPPLSTICQPKAELGKLAVETLLQRIKNPNENYLTLVLEPTCVLRESIYSFK

SEQ ID NO: 3148 - protein, 183 aa, H. influenzae strain 86-028NP
MKENKPVDPYAKYNEQSNIIAKIIFASRWLQVPIYLGLIVTLAIYSYKFIKGLWELVINVNDMDSNTIMLGVLNLIDVVMIANLLVMVTIGGYEIFVSKLRTRNHPDQPEWMSHVNATVLKVKLSMSIIGISSIHMLQTFVNASNMPEKTMMWQLLLHLGFLVSAIALAYTDKILYSTSHKTH

SEQ ID NO: 3149 - protein, 162 aa, H. influenzae strain 86-028NP
MFIDTSELCDLYAEQVDVVEPIFSSFGGVSHFYGKVTTVKCFESNGLIAEVLEENGEGRVLVIDGGGAVRRGLIDAELAQLAVDNGWEGIIVYGAVRQIQQLENLDIGIHALAPIPVSADESSAGESDIPVNFGGVTFFPEDYIYADLTGIILSQEPLDLED

SEQ ID NO: 3150 - protein, 310 aa, H. influenzae strain 86-028NP
VRSKKMINEKLKMWWETARPKTLPLALASIFTGSALGYWANPQGFNGLVMVLCLLTTILLQVLSNFANDYGDHQKGSDTEERIGPLRGIQKGAISAKELKWGLILMVMASFLSGSFLIGIAYENLSDLFAFAGLGILAIVAAITYTVGAKPYGYMGLGDISVLVFFGLLGVGGTYYLQTHSIASHIILPAIGSGLLASAVLNINNLRDIEQDAKASKNTLAVRLGAYKGRVYHCILLSVAALCYLAFAVATATATSWTNYLFVLAMPLLAKHAIFVYRSQQPSELRPMLAQMSMISLLINILFSLGLLIG

SEQ ID NO: 3151 - protein, 239 aa, H. influenzae strain 86-028NP
MNDLTLSPIAIIHTPYKEKFSVPRQPKLVEDGVGIVELLPPYNSPEAVRGLEQFSHLWLIFQFDQIQQGKWQPTVRPPRLGGNQRIGVFASRATHRPNPLGLSKVELRQVECINGNIFLHLGAVDLVDGTPIFDIKPYIAYADSEPNAQSSFAQEKPPVKLTVEFTEQAKSAVKKREEKRPHLSRFIRQVLEQDPRPAYQQGKPSDRIYGTSLYEFNVKWRIKAGTVNCVEVIEIEKDK

SEQ ID NO: 3152 - protein, 328 aa, H. influenzae strain 86-028NP
MLHFAHIFQNKDHTMNITKPFPLPTGYFGIPLGLAALSLAWFHLENLFPAARMVSDVLGIVASVVWILFILMYAYKLRYYFEEVRAEYHSPVRFSFIALIPITTMLVGDILYRWNPLIAEVLIWIGTIGQLLFSTLRVSELWQGGVFEQKSTHPPFYLPAVAANFTSASSLALLGYHDLAYLFFGAGMIAWIIFEPVLLQHLRISSLEPQFRATIGIVLAPAFVCVSAYLSINHCEVDTLAKILWGYGFLQLFFLLRLFPWIVEKGLNIGLWTFSFGLASMANSATAFYHGNVLQGVSIFAFVFSNVMIGLLVLMTIYKLTKGQFFLK

SEQ ID NO: 3153 - protein, 1416 aa, H. influenzae strain 86-028NP
VKDLVKFLKAQSKTSEDFDVIKIGLASPDMIRSWSFGEVKKPETINYRTFKPERDGLFCARIFGPVKDYECLCGKYKRLKHRGVICEKCGVEVTQTKVRRERMGHIELASPVAHIWFLKSLPSRIGLLLDMPLRDIERVLYFEMYIVTEPGMTDLERGQLLTEEQYLDAEDRWQDEFEAKMGAEAIQDLLKGMDLEAECEKLREELQETNSETKRKKITKRLKLLEAFVQSGNKPEWMVMTVLPVLPPDLRPLVPLDGGRFATSDLNDLYRRVINRNNRLKRLLDLIAPDIIVRNEKRMLQESVDALLDNGRRGRAITGSNRRPLKSLADMIKGKQGRFRQNLLGKRVDYSGRSVITVGPYLHLHQCGLPKKMALELFRPFIYAKLESRGYATTIKAAKKMVEREEAIVWDILAEVIREHPILLNRAPTLHRLGIQAFEPILIEGKAIQLHPLVCAAFNADFDGDQMAVHVPLTLEAQLEARALMMSTNNVLSPANGDPIIVPSQDVVLGLYYMTREKVNGKGEGMLLQDPREAEKAYRTGEAELHSRVKVRITEYVKNEAGEFDAKTTLTDTTIGRAILWMIAPKGMPYSLFNQTLGKKAISKLINEAYRRLGLKEAVMFADQIMYTGFAYAARSGSSVGIDDMEIPAKKYEIISAAEEEVAEIQEQFQSGLVTAGERYNKVIDIWAAANERVAKAMMENLSQEEVINREGNPEKQASFNSIFMMADSGARGSAAQIRQLAGMRGLMARPDGSIIETPITANFREGLNVLQYFISTHGARKGLADTALKTANSGYLTRRLVDVAQDLVIVEDDCGTHEGLVMTPLIEGGDEKVPLRELVLGRVAAEDILKPGAEEVLIPRNTLLDEKLCDVLDANSVDSVKVRSVVTCDTDFGVCAKCYGRDLARGHLINQGEAVGVIAAQSIGEPGTQLTMRTFHIGGAASAAAKESSVQVKNTGTVHLMNAKFVTNDESKLVLTSRNTELTITDAFGRTKEHYKVPYGAVLSKGDGQEVTAGETIANWDPHTMPVVSEVSGFVKFVDIIDGLTVTRQTDELTGLSSIVVQDVGERATAGKDLRPTIKLVDANGNDIFLPETDVLAQYFLPGKAIVSLDDGAAVKVGEPLARIPQESVGTKDITGGLPRVADLFEARKPKEPAILAEISGIVSFGKETKGKRRLLITPAEGETYEEMIPKWRQLNVFEGEMVQRGDVISDGAETPHDILRLRGVRAVTEYIVNEVQDVYRLQGVKINDKHIEVIVRQMLRKAVITKAYDSEFLEGEQVEVARVKIVNRQREAEGKPPVEFERELLGITKASLATESFISAASFQETTRVLTEAAVAGKRDELRGLKENVIVGRLIPAGTGFAYHQNRHKHRLVDDVVAKLSEEDEAAIADEFVMTADDASANLAEMLNMADDAE

SEQ ID NO: 3154 - protein, 1343 aa, H. influenzae strain 86-028NP
MGYSYSEKKRIRKDFGKRPQVLNVPYLLTIQLDSFDKFIQKDPEGQQGLEAAFRSVFPIVSNNGYTELQYVDYRLEEPEFDVRECQIRGSTYAAGLRVKLRLVSYDKESSSRAVKDIKENEVYMGEIPLMTDNGTFVINGTERVIVSQLHRSPGVFFDSDKGKTHSSGKVLYNARIIPYRGSWLDFEFDPKDNLFARIDRRRKLPATIILRALGYTTEEILNLFFDKITFEIAGDKLLMTLVPERLRGETASFDIEANGKVYVERGRRITARHIKALEKDNISQVVVPSEYILGKVASKDYVDLESGEIICPANGEISLETLAKLAQAGYTTIETLFTNDLDYGPYISETLRVDPTYDKTSALYEIYRMMRPGEPPTPESSEALFNNLFFSAERYDLSTVGRMKFNRSLAFPEGEGAGILSNEDIIAVMRKLIDIRNGRGEVDDIDHLGNRRIRSVGEMAENQFRIGLVRVERAVKERLSLGDLDAITPQDLINPKPISAAVKEFFGSSQLSQFMDQNNPLSEVTHKRRISALGPGGLTRERAGFEVRDVHNTHYGRLCPIETPEGPNIGLINSLSAFARTNDYGFLETPYRKVVDGQVTEEIEYLSVIDEANYIIAQANSNLDENNRFTDAFVTARGERGESGLYKPEDIHYMDVSTQQVVSVAAALIPFLEHDDANRALMGANMQRQAVPTLRADKPLVGTGMEKPIALDSGVAVVAKRGGTVQYVDASRIVIKVNEDETIAGEAGIDIYNLIKYTRSNQNTCINQIPCVNLGDPINRGEVLADGPSTDLGELALGQNIRVAFMPWNGYNFEDSMLVSERVVQQDRFTTIHIQELSCVARDTKLGAEEITADIPNVGESALSKLDESGIVYVGAEVKGGDILVGKVTPKGETQLTPEEKLLRAIFGEKASDVKDSSLRVPNGTSGTVIDVQVFTRDGVEKDKRALEIEEMQLREAKKDLTEELEILEAGLFARVRNLLISSGADAAQLDKVDRTKWLEQTIADEEKQNQLEQLAEQYEELRKEFEHKLEVKRKKIIKGDDLAPGVLKVVKVYLAVKRQIQPGDKMAGRHGNKGVISKINPVEDMPYDENGQPVEIVLNPLGVPSRMNIGQILETHLGLAAKGIGDQINAMLKQKQEVEKLRSYIQKAYDLLGNGSQKVDLSTFTDEEVLRLAGNLRKGLPVATPVFDGADEAEIKELLKLGGLPTSGQITLYDGRTGEKFERPVTVGYMYMLKLNHLVDDKMHARSTGSYSLVTQQPLGGKAQFGGQRFGEMEVWALEAYGAAYTLQEMLTVKSDDVNGRTKMYKNIVSGNQHMEPGTPESFNVIMKEIRSLGLNIELDEE

SEQ ID NO: 3155 - protein, 229 aa, H. influenzae strain 86-028NP
MAKLTKKMKAIKAGVDSTKAYEINEAIAVLKQFATAKFVESVDVAVNLGIDPRKSDQNVRGATVLPHGTGREVRVAVFTQGANADAAKEAGADLVGMEDLAEQIKKGEMNFDVVIASPDAMRVVGQLGQVLGPRGLMPNPKVGTVTPNVAEAVKNAKSGQIRYRNDKNGIIHTTIGKANFSEVQLKENLQALLAALNKAKPTTAKGIFIKKVSISTTMGAGVAVDQASL

SEQ ID NO: 3156 - protein, 142 aa, H. influenzae strain 86-028NP
MAKKVQAYVKLQVAAGMANPSPPVGPALGQQGVNIMEFCKAFNARTESLEKGLPIPVVITVYADRSFTFVTKTPPAAVLLKKAAGIKSGSGKPNKDKVGKVTLDQVRQIAETKAADMTGATIETKMKSIAGTARSMGLVVEE

SEQ ID NO: 3157 - protein, 238 aa, H. influenzae strain 86-028NP
MTPHINAPEGAFADVVLMPGDPLRAKYIAETFLQDVVEVTNVRNMLGFTGTYKGRKISIMGHGMGIPSCSIYAKELITEYGVKKIIRVGSCGTVRMDVKVRDVIIGLGACTDSKVNRIRFKDNDFAAIADFDMAQAAVQAAKAKGKVVRVGNLFSADLFYTPDVEMFDVMEKYGILGVEMEAAGIYGVAAEYGAKALTICTVSDHIRTHEQTTAEERQLTFNDMIEIALDSVLIGDAL

SEQ ID NO: 3158 - protein, 417 aa, H. influenzae strain 86-028NP
MSVLSSILGMVVLIAIAVLLSNNRKAISIRTVVGALAIQVGFAALILYVPAGKQALGAAADMVSNVIAYGNDGINFVFGGLADPSKPSGFIFAVKVLPIIVFFSGLISVLYYLGIMQVVIKVLGGALQKALGTSKAESMSAAANIFVGQTEAPLVVRPYIKNMTQSELFAIMVGGTASIAGSVMAGYAGMGVPLTYLIAASFMAAPAGLLFAKLMFPQTEQFTDKQPEDNDSEKPTNVLEAMAGGASAGMQLALNVGAMLIAFVGLIALINGILSGVGGWFGYGDLTLQSIFGLIFKPLAYLIGVTDGAEAGIAGQMIGMKLAVNEFVGYLEFAKYLQPDSAIVLTEKTKAIITFALCGFANFSSIAILIGGLGGMAPSRRSDVARLGIKAVIAGTLANLMSATIAGLFIGLGAAAL

SEQ ID NO: 3159 - protein, 262 aa, H. influenzae strain 86-028NP
MTALSEIFVPLHRIIPFSNVEGQGNRSSIFLQGCKLNCLYCHNPETIPRYTESAKLVSLQYLYEQVMEAVPFIRGVTVSGGEPTIHHKKLVPLFKALRSQGLTCYLDSSGFFEFDRVCSLIDVTDKFLFDLKGEGIGLQTLCFDRKNQAGIVSQQVILERLHIKNDKLERNLQNLAALLPLNKVEEVRLVFLKHFFDAEHLVGKVAQLLRNYPDVALKIICVHSKGVRDEAGLSAYIPSVEETNALSAYARQCGINKILTIL

SEQ ID NO: 3160 - protein, 514 aa, H. influenzae strain 86-028NP
MLASLQDILDTVKANNLTYHQKLMTLGNIAERLFDPRDLLGYTDEEWGFLQNQMICDLCEGYAIYRPRYILPDYNVYIQKGCEFLELPPPKDLDEALDGLLILYSRVPSITTYPVYVGRLDVLLEPFITDEEKDYIKIKRFLNHIDKTVPDSFCHANIGPYDTKAGRLILRAVIELEAPTPNMTIRYDKSKTSRDFAELAAKACLLVSKPSFANDAYYISDLGEEYGVASCYNALPECGGAYTLTRLRLGTIARTCKSADEMLNELLPRVAKCALSTMDKRHKFVVEESNFFNSSFLEKEGFIKRTNFTGMFAIVGLADAANHLLQCEGLNETFGKSVRGDEIATAIMDKLKEITDAHEGVYAERTGNRYLLHAQVGASNHEEDKRNAPAHRIRVGEEPTLLAHLKQSAPFHKYFPSGTGDLFAFDQTYVDHCDAVVDIIDGAFSLGYRYITTYLKNTDLIRVTGYLVKKSEVEKYRKGEVALRDTTWYGSGTDECANVFDRQLRNEKDVIAEK

SEQ ID NO: 3161 - protein, 218 aa, H. influenzae strain 86-028NP
MKKKVRVIPRTSWAATSLWTAQYKTISILLFALSILGIGDGLIVLSGLGSTPWTVLSQGIAIQTNFDIGWSSFLISCAVMLVWKPLKLRLGLGTLLNIIVIALFLGITTKILTPPTALFSRMIFCLIGILLYGFGTALYLTCHLGAGPRDGLMVGICQRFHLSINVVRSSLEISVCLLGFLLGGVVGLGTVLFATSIGSVVQFFLNIIARLPHIPYEK

SEQ ID NO: 3162 - protein, 356 aa, H. influenzae strain 86-028NP
VRFFYFSGEIMEKILVIRNDKLGDFMQAWPAFAMLKASNPELKLTALVPSYTAPLAEICPFIDDVIIDSKKNDKTDFKRLVQEIKAQQFDGMISFFSNTHNGKLAWKSGIKYRLAPATKWVQILYNHRLTQRRSRSEKSEAEYNQDLVRTFLQKHNMPVVEPKPPYLIFEKSAVENQRVFLQESLGLSANKKWIFVHSGSGGSATNLSLAQYADLIKGLLAEFDCNIVLTAGPGEREKAYELANLVNDLRVAIYDKNKGLVDFAHSLACADLFIAGSTGPLHLSSAFNIPTIGFYPNSRSSQPRRWKPINDVDKHLAFCPPAGKETQMNLELISIDNALAEISLFIRNMWQTSNNI

SEQ ID NO: 3163 - protein, 359 aa, H. influenzae strain 86-028NP
MAKLLDIVKPGVVTGEDVQKVFAYAKEHNFAIPAVNCVGSDSVNAVLETAARVKAPVIIQFSNGGAAFYAGKGIKPTSGTRPDVLGAIAGAKQVHTLAKEYGVPVILHTDHAAKKLLPWIDGLLDAGEKHFAETGRPLFSSHMIDLSEESMEENMAICREYLARMDKMGMTLEIEIGITGGEEDGVDNSDVDESRLYTQPSDVLYVYDQLHPVSPNFTVAAAFGNVHGVYKPGNVKLKPSILGASQEFVSKERNLPAKPINFVFHGGSGSSREEIREAIGYGAIKMNIDTDTQWASWNGILNFYKANEAYLQGQLGNPEGPDAPNKKYYDPRVWLRKMEESMSKRLEQSFEDLNCVDVL

SEQ ID NO: 3164 - protein, 386 aa, H. influenzae strain 86-028NP
MSVIKMTDLDLAGKRVFIRADLNVPVKDGKVTSDARIRATIPTLKLALEKGAKVMVTSHLGRPTEGEFTPEDSLQPVVDYLKNAGFNVRLEQDYLNGVDVKDGEIVVLENVRINKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 3165 - protein, 264 aa, H. influenzae strain 86-028NP
MKKLTSILSLIVLVILAIWQYFTDTTKTKHQSSSPVIEQTKQTKVSEPKFEPKFEPQFETKRTDIEKSAVKNPDVFANYDVIMRNDHIGQNAKAPVDYYMLALSWSPGFCDIQREKYGDQLPYSSQYQCGNNRTFGWVVHGLWPQNANARAVSDHPRFCKGDLPALPKGLLAQYLAISPGEKLLQGEWEKHGSCAFDSAQQYFAKEQELFNALKLPNQKLSRDELFGWMKQHNPQLKNAYLRASRNELFICYDKKWQVMNCQSK

SEQ ID NO: 3166 - protein, 86 aa, H. influenzae strain 86-028NP
MALFITSKCTNCDMCLPECPNEAISIGDEIYVIDPILCTECVGHYDTPTCQKVCPITNCIKPDPEHQETEEQLWERFVMIHHSDKL

SEQ ID NO: 3167 - protein, 406 aa, H. influenzae strain 86-028NP
MLKNKTFGSALIIAGTTIGAGMLAMPLTSAGMGFGYTLLLLVGLWALLVYSGLLFVEVYQTADQLDDGVATLAEKYFGVPGRIFATLSLLVLLYALSAAYITGGGSLLSGLPTAFGMDAISLKTAIIIFTVVLGSFVVVGTKGVDGLTRVLFIGKLVAFAFVLFMMLPKVATDNLMALPLDYAFVVSAAPIFFTSFGFHVIMASVNSYLGGSVDKFRRAILIGTAIPLAAYLVWQLATHGVLSQSEFVHILQADPTLNGLVNATREITGSHFMGEVVRVFSSLALITSFLGVMLGVFEGLGDLFKRYHLPNNRFVLTVAAFLPPLVFALFYPEGFITALSYAGLLCAFYCLILPISLAWRTRIENPTLPYRVSGGNFALVFALLIGVVIMLIPFLIQWGYLPVVAG

SEQ ID NO: 3168 - protein, 193 aa, H. influenzae strain 86-028NP
MAKLYFYYSTMNAGKSTTLLQSSYNYRERDMSTLVYTAAIDDRFGVGKVTSRIGISQDAFLFRSETNLFDEINEHLKKEKVHCVLVDEAQFLSKQQVYQLSDVVDKLKIPVLCYGLRTDFQAELFEGSKYLLAWADQLEELKTICYCGRKANFVLRLNDQGEVIKEGAQIQIGGNDSYLSVCRLHYKEKCGQI

SEQ ID NO: 3169 - protein, 342 aa, H. influenzae strain 86-028NP
MKILGIETSCDETGVAIYDEEKGLIANQLYTQIALHADYGGVVPELASRDHIRKTAPLIKAALEEANLTASDIDGIAYTSGPGLVGALLVGATIARSLAYAWNVPAIGVHHMEGHLLAPMLDENSPHFPFVALLVSGGHTQLVRVDGVGKYEVIGESIDDAAGEAFDKTAKLLGLDYPGGAALSRLAEKGTPNRFIFPRPMTDRAGLDFSFSGLKTFAANTVNQAIKNEGELTEQTKSDIAYAFQDAVVDTLAIKCKRALKETGYKRLVIAGGVSANKKLRETLAHLMQNLGGEVFYPQPQFCTDNGAMIAYTGFLRLKQGQHSDLAIDVKPRWAMTELPAI

SEQ ID NO: 3170 - protein, 71 aa, H. influenzae strain 86-028NP
MPVIKVRENESFDVALRRFKRSCEKAGILAEVRAREFYEKPTTIRKRENATLAKRHAKRNARENARNTRLY

SEQ ID NO: 3171 - protein, 593 aa, H. influenzae strain 86-028NP
MKGSIPRPFIDDLLTKSDIVDVINTRVKLKKAGRDYQACCPFHHEKTPSFTVSQKKQFYHCFGCGAHGNAISFLMDYDKLEFIEAIEELAAMAGLEIPYEKRANHSGKPQANYQTKRNLYELMQEIATFYQNQLPLNTQAQEYLQQRGLSPEIIERFQIGFVPNAMDTVLRKFGVNREEQQKLIELGMLSRNDRGNIYDKFRNRIMFPIRDKRGRTVAFGGRVLTDEKPKYLNSPETITYHKGKELYGLYEALQTNDEPKQLLVVEGYMDVVALAQFGVDYAVASLGTSTTSEQIQLIFRSTEQVVCCYDGDRAGRDAAWRALENALPYLEDGRQLKFIFLPDGEDPDTYIRQYGKEKFEEYIESAQSLSEFMFAHLSPQVDFSTKEGRGKLVALAAPLIHQIPGEMLRLSLRNMLAQKLGIFDQTQLENLIPKQLEQANTQQKVTHNKIKKTPMRMVISLLLQNPELVKRMSESGVQALRAEAGFEILEKLTALCRQREGITTGQILEYFRNTSYSNPLEILATWDHLLDESDIINAFSQNYRRLNIQAIERDIEMLIAKERTEGLTNEEKTVLVHLLAGKEQQKKQLVNPL

SEQ ID NO: 3172 - protein, 623 aa, H. influenzae strain 86-028NP
MEKNQQSTAEQYSEQIEQLMELGRTQGYLTFAEINDLLPEDAIDPEYYDKLLQTLQNDAGIPVLDEAPESDDMMLSDTIPDEDAVEEATQILSNVESEIGRTTDPVRMYMREMGTVDLLTREDEISIAKRIEGGIDEVQTSIAAYPEALNGLLKNYDDVEKGNFRLTDLITGFVDPNAEIEEHNGLDEDFSDEDDEEESSNADVEDNESESTSDSSDSDNSIDPEVAREKFQQLREQHSKTLAVIEKHGRSGKRAQDQIALLGEIFKQFRLVPKQFDLLVLSMKEMMKRVRYQERQLQKILVDIAGMPKDDFEKIITANGSNSEWVAKALKSSKPWAKRLIKYEDRIYEALNNLAITEENTKLTITQMRDICDAVARGEQKARRAKKEMVEANLRLVISIAKKYTNRGLQFLDLIQEGNIGLMKAVDKFEYRRGYKFSTYATWWIRQAITRSIADQARTIRIPVHMIETINKLNRISRQLLQEMGREATPEELAERMGMPEDKIRKVLKIAKEPISMETPIGDDDDSHLGDFIEDSTLELPLDSATAQSLKVATHEVLEGLTPREAKVLRMRFGIDMNTDHTLEEVGKQFDVTRERIRQIEAKALRKLRHPSRSETLRSFLDE

SEQ ID NO: 3173 - protein, 475 aa, H. influenzae strain 86-028NP
VIKMTQFRKEVDLLGERDVPAEAYWGIHTLRAVENFNISNVTISDVPEFVRGMVMVKKATALANGELGAIPSDIAKAIVAACDEILTTGKCLDQFPSDVYQGGAGTSVNMNTNEVVANLALEKIGHKKGEYNVINPMDHVNASQSTNDAYPTGFRIAVYNSILKLIDKIQYLHDGFDNKAKEFANILKMGRTQLQDAVPMTVGQEFKAFSVLLEEEVRNLKRTAGLLLEVNLGATAIGTGLNTPQGYTELVVKHLAEVTGLACVPAENLIEATSDCGAYVMVHGALKRTAVKLSKVCNDLRLLSSGPRAGLKEINLPELQAGSSIMPAKVNPVVPEVVNQVCFKVIGNDTTVTFASEAGQLQLNVMEPVIGQAMFESIDILTNACVNLRDKCVDGITVNKEICENYVFNSIGIVTYLNPFIGHHNGDLVGKICAQTGKGVREVVLEKGLLTEEQLDDILSVENLMNPTYKAKLNK

SEQ ID NO: 3174 - protein, 271 aa, H. influenzae strain 86-028NP; identical to SEQ ID NO: 632

SEQ ID NO: 3175 - protein, 225 aa, H. influenzae strain 86-028NP
MSNTVATMINKRNIMRNYIKIGVAGPVGAGKTALIEKLTREIASKYSVAVITNDIYTQEDAEFLTKNSLLPPERIMGVETGGCPHTAIREDASMNLEAVDEMVTRFPDVEIVFIESGGDNLSATFSPDLADVTIFVIDVAQGEKIPRKGGPGITRSDLLVINKTDLAPFVGVDLSVMERDARRMRNGQPFIFTNLMKKENLDGVIGWIEKYALLKNVEEPASLVR

SEQ ID NO: 3176 - protein, 235 aa, H. influenzae strain 86-028NP
LAQTLNRSLTDLGALLHLVDPTLPIGGFNHSNGLETFVQQRVVESKATLEEYVQTQLLQNWIYNDGAYLSLAFDAMCEGNFDRLCELDWQLSATKVARESREGSFKLGVRLLKIFIRYETHTLLTAYQQAIAEKRVQGYFPIVFAMVAQAMGLSKADTLYAFYYNAAVGAITNGVKLIPLSQMDGQDILFDLRGSLVQAVELSFDPDEEWLGAATLANDIRAMQHEVLYTRLYMS

SEQ ID NO: 3177 - protein, 185 aa, H. influenzae strain 86-028NP
MKIINPILPIIENILGNLTALQAEGKITTQPIERVALQWYESERNILRKTTNTGREVAFRLLKEGQRLKHDDVVFISDELVIAIEILPSDVIVLSPKTLPEMARACYEIGNKHSPLFLDGDEVTLPYDKPMFEWLQAAGFHPQKAERRLSQALRANSAQGHGHSHSHSHDHHGYHHHGDGHWHKH

SEQ ID NO: 3178 - protein, 572 aa, H. influenzae strain 86-028NP
MALTISRAQYVATYGPTVGDKVRLGDTNLWATIEQDLLTKGDECKFGGGKSVRDGMAQSGTATRDNPNVLDFVITNVMIIDAKLGIIKADIGIRDGRIVGIGQAGNPDTMDNVTPNMIIGASTEVHNGAHLIATAGGIDTHIHFICPQQAQHAIESGVTTLIGGGTGPADGTHATTCTPGAWYMERMFQAAEALPVNVGFFGKGNCSTLDPLREQIEAGALGLKIHEDWGATPAVIDSALKVADEMDIQVAIHTDTLNESGFLEDTMKAIDGRVIHTFHTEGAGGGHAPDIIKAAMYSNVLPASTNPTRPFTKNTIDEHLDMLMVCHHLDKRVPEDVAFADSRIRPETIAAEDILHDMGVFSIMSSDSQAMGRIGEVVIRTWQTADKMKMQRGELGNEGNDNFRIKRYIAKYTINPAIAHGIAEHIGSLEVGKIADIVLWKPMFFGVKPEVVIKKGFISYAKMGDPNASIPTPQPVFYRPMYGAQGLATAQTAVFFVSQAAEKADIREKFGLHKETIAVKGCRNVGKKDLVHNDVTPNITVDAERYEVRVDGELITCEPVDSVPLGQRYFLF

SEQ ID NO: 3179 - protein, 101 aa, H. influenzae strain 86-028NP
MIPGEYQLAEGDILANVGRKTVKIEVTNSGDRPIQVGSHYHFFETNNALKFDRTLARGMRLNVPSGNAVRFEPGEVKSVELVAFGGNQIIYGFHNQIDGKL

SEQ ID NO: 3180 - protein, 100 aa, H. influenzae strain 86-028NP
MHLTSREQEKLMLFLAGELAAKRKARGVKLNYPETIAYIASHLQEAARDGMSVAEVMQYGATLLTVDDVMEGVAEMVHEVQIEATFPDGTKLVTVHNPIR

SEQ ID NO: 3181 - protein, 96 aa, H. influenzae strain 86-028NP
MNIRPLHDRVIIKREEVETRSAGGIVLTGSAATKSTRAKVLAVGKGRILENGTVQPLDVKVGDTVIFNDGYGVKAEKIDGEEVLIISENDILAIVE

SEQ ID NO: 3182 - protein, 545 aa, H. influenzae strain 86-028NP
MAAKDVKFGNDARVKMLKGVNVLADAVKVTLGPKGRNVILDKSFGAPTITKDGVSVAREIELEDKFENMGAQMVKEVASKANDAAGDGTTTATVLAQAIVNEGLKAVAAGMNPMDLKRGIDKAVSAVVSELKNLSKPCETAKEIEQVGTISANSDSIVGQLISQAMEKVGKEGVITVEDGTGLEDELDVVEGMQFDRGYLSPYFINKPETATVELDNPYLLLVDKKISNIRELLPVLEGVAKAGKPLLIIAEDVEGEALATLVVNTMRGIVKVAAVKAPGFGDRRKAMLQDIAILTAGTVISEEIGMELEKATLEDLGQAKRVVINKDNTTIIDGIGDEAQIKGRVAQIRQQIEESTSDYDKEKLQERVAKLAGGVAVIKVGAATEVEMKEKKDRVDDALHATRAAVEEGIVAGGGVALVRAAAKVAASLKGDNEEQNVGIKLALRAMEAPLRQIVTNSGEEASVVASAVKNGEGNFGYNAGTEQYGDMIEMGILDPTKVTRSALQFAASVAGLMITTECMVTDLPKDDKADLGAAGMGGMGGMM

SEQ ID NO: 3183 - protein, 149 aa, H. influenzae strain 86-028NP
MQVILLDKIAHLGQVGDQVNVKSGFARNFLIPQGKAVMATKANIEHFEARRAELEATAAANLAAAQARAAEVTALGSVTIASKAGDEGRLFGAITTRDVAEAVTAAGVKIAKSEVRLPNGPIRTLGDHDVRFQLHGEVFATLDVIVVAE

SEQ ID NO: 3184 - protein, 75 aa, H. influenzae strain 86-028NP
MARYFRRRKFCRFTAENVVEIDYKDIATLKNYISESGKIVPSRITGTRAKYQRQLARAIKRARYLALLPYTDNHQ

SEQ ID NO: 3185 - protein, 108 aa, H. influenzae strain 86-028NP
MLKSNLKIDNRFSVMGVVSQLPKRLKSPSGIEHCKFLLEHRSDQIESGFTRQAWLKMPVQISGNQLIEKTQSITVGSKILVVGFITSHKTQSGLCQLVLHAEQIEFID

SEQ ID NO: 3186 - protein, 125 aa, H. influenzae strain 86-028NP
MRHYEIVFMVHPDQSEQVPGMIERYTGSVKEAGGQVHRLEDWGRRQLAYPINKLHKAHYVLMNVEAPQQVIDELETTFRYNDAVLRSLVIHTKHAVTEASPMKAAKEERKPLAEVENNDFEDAEE

SEQ ID NO: 3187 - protein, 84 aa, H. influenzae strain 86-028NP
VRIKNRLFLEDTMAKEDCIEMQGTILETLPNTMFRVELENGHVVTAHISGKMRKNYIRILTGDKVTVEMTPYDLSKGRIIFRSR

SEQ ID NO: 3188 - protein, 287 aa, H. influenzae strain 86-028NP
MNSKKHLGHTARKRFGQNFLHDTSVIQGIVAAIYPQPNQFLVEIGPGLGALTEPVGELVDHLTVVELDRDLAERLRHHPFLHQKLTVIETDAMQFDFDELYTTENLAEKGQKLRVFGNLPYNISTPLMFHLFKYHDVIQDMHFMLQKEVVKRLCAGPNSKAYGRLTIMAQYFCQVMPVLEVPPSAFKPAPKVDSAVVRLIPHKELPHPVKDLYWLNRVCSQAFNQRRKTLRNALSTLFSPENLTALGIDLNARAENLAIADYARLANWLADNPPADVNNDEILDSEE

SEQ ID NO: 3189 - protein, 312 aa, H. influenzae strain 86-028NP
LLIYSFRIVECKKFSYFHFYLNMSAIENIVISMENATERRKHITKQFESKKLSFSFFNAYTYQSINQSINQSINQSINQSISILHNIEESRILTKGEKGCLISHFLLWNKCVNENLEYLTIFEDDVILGENAEVFLAQDEWLKTRFDFNDIFIIRLETFLQPVKLEKQTKIPPFYSRNFDILKSTHWGTAGYIISQGAAKYVIEYLKNIPSDEIVAVDELIFNKLVDVDNYIVYQLNPAICIQELQANQSKSVLTSGLEKEREKRPKIRKKKTLKQRLTRIKENIIRALNRKKWKEQQRIKEMQGKEIVRFM

SEQ ID NO: 3190 - protein, 275 aa, H. influenzae strain 86-028NP
MATYFVGDLQGCYDELQLLLERVNFNPTQDKLYLVGDLVARGDKSLECLRFVKSLGDSAQTVLGNHDLHLIATALGIKKVKPRDRVDAIFNAPDFDELIHWLRHQPLLVHNKKLNFLMVHAGISPDWNLETAKSCAAEVEQILQNGDFHYLIENMYSEQPDRWSPDLQGLARHRYIINAFTRMRFCYLDHRLDFACKSPLKYAPTELTPWFNLGNPLYKQIPIVFGHWASLVDEPTPKGVYALDTGCVWNNRMTMLRWEDKQIFTQSAVKNYSDF

SEQ ID NO: 3191 - protein, 207 aa, H. influenzae strain 86-028NP
MLSLTAESCELFNIPFYQFAQMKKFCPEDIPAIKADYKLHWDNWKAIIQSVSAQLGTPFAKPHIESWTNGWQVRAHFFAYFKYEFNQNSAAIFSVLLNRRRLRVCLDWHCYRADRSQINVQQYNQWLDQFDFKQFADFEIWREDESEYDDFRQVKVISEKNLILRSDEDFWCIGKSIEKAELNQIDPILFITHTIQQLQPLYDRCHQ

SEQ ID NO: 3192 - protein, 484 aa, H. influenzae strain 86-028NP
MSVKGDIGVIGLAVMGQNLILNMNDHGFKVVAYNRTTSKVDEFLQGAAKGTNIIGAYSLEDLASKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYDEMQAIFAEWKNTELDSYLIDITTDILGYKDASGEPLVEKILDTAGQKGTGKWTGINALDFGIPLTLITESVFARCVSSFKDQRVAANQLFGKTITPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 3193 - protein, 180 aa, H. influenzae strain 86-028NP
MTTKYNAGIHHRSSIRLKHYNYRSEGFYFITICCKNKECLFGHIINQQMQLNDLGNYVKQCWENIPMFFPQVRIDEFVIMPNHLHGIIEIIEQVKGKCNLPLQSRVTQLPQKGTSQTIGSIVRGFKAGVTSWARKNSEIFDVWQRNYYEHIIRDEKSYLQIYEYIQNNPILWEQDQLYVD

SEQ ID NO: 3194 - protein, 62 aa, H. influenzae strain 86-028NP
MFTIESKSGVRQSRVIQRLLAAGIIFGYAINQISVIYFFLGCVIIAAVFGAVTTKNKGILVK

SEQ ID NO: 3195 - protein, 245 aa, H. influenzae strain 86-028NP
VGIFTYDIINGTAMNTITFPTAQHAVEKIAQEFVIYSQLNRPVHISLSGGSTPKLLFKTLAKLPYAEQINWKNLHFWWGDDRMVPPSDPESNYGEVQKLLFDHIQIPAENIHRICGENEPHFELKRFEEELSAVIPNGIFDWIILGMGTDGHTASLFPHQTNFDDENLAVIAKHPESGQIRISKTAKLIEQAKRITYLVTGESKADILKEIKTTPAENLPYPAAKIKAKNGVTEWYLDKAAARLL

SEQ ID NO: 3196 - protein, 494 aa, H. influenzae strain 86-028NP
MQTDNNCIVIFGASGDLTHRKLIPALYNLYKIGRLSENFSVLGVARSDLNDETFRKKMREALIHNEETTPDTLDAFCSHLYYQAVNTSDAQDYGKLVPRLDELHDKYQTCGNTLYYMSTPPSLYGVIPECLAAHGLNTEEYGWKRIIVEKPFGYDEKTAQALDVQIHRFFEEHQIYRIDHYLGKETVQNLLVLRFSNGWFEPLWNRNFIDYVEITGAESIGVEERGGYYDGSGAMRDMFQNHLLQVLAMVAMEPPAIINANSMRDEVAKVMHSLRPLTSEDMENNLVLGQYTAAEINGKMEKGYLEEKGVPADSRTETYISLRCEIENWRWAGVPFYVRTGKRLPARVTEIVIHFKTTPHPVFSQNAPENKLIIRIQPDEAISMRFGLKKPGAGFEAKEVSMDFRYADLAGTQVLTAYERLLLDAMKGDATLFARTDAVHAAWKFVQPILDYKANGGRIHEYEAGTWGPVAADKLIAKQGKVWRKPSGLMKKKV

SEQ ID NO: 3197 - protein, 269 aa, H. influenzae strain 86-028NP
MLTLNEHLLNQVLLIAYQAGKHLQQFYQKQVHVELKEDNTPVTEADLFVSQFLTEKLTALFPNVPVLSEENCHISFEERKNWKEYWLIDPLDGTQQFINRTDQFSVLITLVRKNKPVLSIIHAPILSITYYAMRDFGAFKKQLDQVKKLTKNTTNFDRPLRIAVGATTSQEKVRSILPKDFTCEFVVVGSSSLKSGLVAEGAVDCYVRLGQTGEWDTAGAEVLLNETHGAIFDSHFEPLTYNQRETLINPHFVMVGDQSFDWRSVFQFN

SEQ ID NO: 3198 - protein, 138 aa, H. influenzae strain 86-028NP
MKSYLKTLIFFPLILQIVVTALLIWFDDDSSGVIVPFSSYALTAFLLATIPAFLTALLAAKFRYTRYNIASIVLVSSIISFVYCNMASYFYLLLLGEQDTSFWGWLTEGGLSLGLISTCGMVFYALFVMPWLLPKTRE

SEQ ID NO: 3199 - protein, 660 aa, H. influenzae strain 86-028NP
MHNENLKELTVRGIILGALITVIFTASNVYLGLKVGVTFASSIPAAVISMAVLKFFKDSSILENNMVQTQASSAGTLSSVIFVLPGLLMMGYWQDFPFWQTMLICAAGGTLGVLFTIPLRRAMVVNSNLPYPEGVAAAEILKAGNHADGDSGVKDIAYGGVLAGLVAFLTNGLRVMADGSAWIQTGKAAFQLPMGFSLALLGAGYLIGIVGGIAMLIGVILTWGVAVPYFTMSEDIAADASLIDSAMTVWKTKVRYIGVGTIGIAAIWTLLILMKPMIEGMVHSFRMLKGGQEASEHRIDIDLSPKTMIYILIATVALIVISLHHFIAAAPISPELSILLVVVCTFLAVFIGFFVAAASGYMAGLVGSSSSPISGIGIISVIVISLVLVSIGNASGLFETVDGQKFLTALTLFTASIVITTACISNDNLQDLKTGLLVEATPWRQQVALIIGCFVGALVIAPVLEILYHAYGFSGALPRPDMDPSQALSAPQATLMTAISQGIFTNKLEWTYILTGVGLGAVLITIDAFLKKVSNKVFSLPVIAVGIGIYLPPSINTPVIVGAFLAWIMARHIAKLGNKEVSAKAERFGTLFSAGLIVGESLMGVILAFIIAASVTTGGSEAPLSLNLENWDTIGEWFGLIVFIVGIVIFASRVLRAKKI

SEQ ID NO: 3200 - protein, 131 aa, H. influenzae strain 86-028NP
MAEKEVRLDKWLWAARFYKTRSIAKAMIESGKVHYNNQRAKVSKIVEVGAMLKLRQGNEEKEIKIIALSDQRRGAPEAQLLYQETESSVKKREEIAWARKNNSLSMPHPDRRPNKKERRDLLKFKHQDKFE

SEQ ID NO: 3201 - protein, 150 aa, H. influenzae strain 86-028NP
MHNIDSLDQKILRVLTKDARTPYAEMAKNFGVSPGTIHVRVEKMRQSGIIKGTKVIIDERKLGYDVCCFIGIILKSAKDYEKVIKKLESFDEVVEAYYTTGNYSIFLKVMTHTIAELHSVLATKIQLIDEIQSTETLISMQNPILRDIKP

SEQ ID NO: 3202 - protein, 330 aa, H. influenzae strain 86-028NP
MKKTFILQQQEISFVKNTFTQNLIEQLGIIEVQGPILSQVGNGMQDNLSGIEKAVQVNVKCIPNAIFEVVHSLAKWKRHTLARFNFKEDEGLFVHMKALRPDEDSLDPTHSVYVDQWDWEKVIPEGRRNFAYLKETVNSIYRAIRLTELAVEARFDIPSILPKQITFVHSEDLVKRYPDLSSKERENAICKEYGAVFLIGIGGKLSDGKPHDGRAPDYDDWTTESENGYKGLNGDILVWNDQLGKAFELSSMGIRVDESALRLQVGLTGDEDRLKMDWHQDLLNGKLPLTIGGGIGQSRLAMLLLRKKHIGEVQSSVWPKEMLEEFSNIL

SEQ ID NO: 3203 - protein, 117 aa, H. influenzae strain 86-028NP
MLVQEMLLQAVKKLQRNANLILHSDQGIHYQMLSYQRLLAKNRISQSMSRKGNCLDNAAMESFFGRLKTECFYGREFNSREEIVDAVRDYLDYYNHRRIQLKLKGLSPIQYRKQSFK

SEQ ID NO: 3204 - protein, 285 aa, H. influenzae strain 86-028NP; identical to SEQ ID NO: 674

SEQ ID NO: 3205 - protein, 38 aa, H. influenzae strain 86-028NP
LPGVNHIVESWLNMASFKVCREKGIAWTMQRWKVSLGD

SEQ ID NO: 3206 - protein, 46 aa, H. influenzae strain 86-028NP
LGGGGILAYLGFIGGRPDGLRGISPFMPLFSNRFNHVPTKALEGIL

SEQ ID NO: 3207 - protein, 224 aa, H. influenzae strain 86-028NP
MNTQFKLIGFDLDGTLVNSLPDLALSVNSALAEFNLPKAPEELVLTWIGNGAPVLIARALDWAKKQTGKVLTETEVKQVTERFNFYYGENLCNVSRLYPNVKETLETLKEKGYVLAVVTNKPTRHVQPVLAAFGIDHLFSEMLGGQSLPAIKPHPAPLYYLCGKFGFEPRQVLFVGDSKNDIIAAHAAGCAVVGLTYGYNYNIPITESNPDWVFDDFAQLLTIL

SEQ ID NO: 3208 - protein, 234 aa, H. influenzae strain 86-028NP
MHSFSQRRTFMKPYLIAPSILSADLARLGDDVQNVLNAGADVIHFDVMDNHYVPNLTFGPAVCQALRDYGITAPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 3209 - protein, 806 aa, H. influenzae strain 86-028NP
MSETTNDNYGASSIKVLKGLDAVRKRPGMYIGDTDDGTGLHHMVFEVVDNAIDEALAGHCSDIIVTIHDDNSVSVQDDGRGIPVDIHPEEGVSAAEVIMTVLHAGGKFDDNSYKVSGGLHGVGVSVVNALSDKLQLTIRRQGHVHEQFYHLGEPQSPLTVIGETEATGTTVRFWPSSDIFAITTFDYKILAKRLRELSFLNSGVSIRLIDKRDGSEDHFHYEGGIQAFVEYLNKNKNPIHPKPFYFTAEKDGIGVEVALQWNDGVNENVYCFTNNIPQRDGGTHLAGFRGALTRSLNSYMENEGMLKKEKVATSGDDAREGLVAIISVKVPDPKFSSQTKDKLVSSEVKSAVESAMNEKMQEYLLENPADAKIIVNQIIMAARAREAARKAREMTRRKGALDIAGLPGKLADCQEKDPALSELYLVEGDSAGGSAKVGRDRKTQAILPLKGKILNVEKARFDKMLSSQEVGTLITALGCGIGRDEYNPDKLRYHHIIIMTDADVDGSHIRTLLLTFFYRQMPELIERGYVYIAQPPLYKVKKGKQERYIKDADEMEQYELTLALDGAELHISANAPAMNALVFEKLVAEYNSVQKLIGRLNRHYPVPVLQGLIYQSPISIEMMKEESAVENWGKSFVEQLTAKETEAHQYSVRTQFNAERQVYEAVITVRKHGIDTDYFLNFDFVHGNEYAKIVSLNKQLNGLLEEGAYVTRGEKVQPVRSFEQAVEWLVKESRKGLEVQRYKGLGEMNADQLWETTMDPNSRRMLKVSIKDAVAADQLFTTLMGDEVEPRREFIELNALRANLDV

SEQ ID NO: 3210 - protein, 770 aa, H. influenzae strain 86-028NP
MLNQQISQIIAAELTVQPQQILAAIQLLDDGNTIPFIARYRKEATGGLDDTQLRHFETRLIYLRELEERRQTILKSIEEQGKLTDELRDKIHATQSKTELEDLYLPYKPKRRTKGQIAIEAGLEPLANLLWNEPKNDPESTALSFVDADKGVTDTKVALDGARYILMERFAEDAGLLAKVRDYLAKNAVIVSKVIEGKETEGAKFQDYFDHQELLKNVPSHRALAMFRGRNEGILQLSLNADPDAEEGSRQSYCEEIIRDYLDVRFTSQPADKWREQVIAWTWKIKVSLHLETELMASLREKAEEEAIDVFARNLTALLMAAPAGAKSTMGLDPGLRTGVKVAVVDNTGKLLDTTTIYPHTGREAEAQVAIFSLIRKHNVELIAIGNGTASRETERFAKEVIKEIKENKPQTVVVSEAGASVYSASEFAANEFPNLDVSLRGAVSIARRLQDPLAELVKIEPKAIGVGQYQHDVNQSQLARKLDAVVEDCVNAVGVDLNTASAPLLARVAGMTKTLAQNIVEYRDENGRFESRRELKKVPRLGPKAFEQCAGFMRIAGGKNPLDASGVHPEAYPVVEKILQATAQSIQDLMGNAGVVRQLDAKQFIDEQFGLPTVQDIFKELEKPGRDPRGEFKTAVFAEGVEEITDLKSGMILEGTVTNVTNFGAFVDIGVHQDGLVHISSLSDKFVEDPLQVVKTGNIVKVKVLEVDVLRKRIALTMRLDESAVKNDGKSDRTLSARPRGNTQREARSSRGNNAMGNAFADALKNWKK

SEQ ID NO: 3211 - protein, 158 aa, H. influenzae strain 86-028NP
MAKSNYITRQGWLVLDQELKFLWKEERPKVTQAVSDAAALGDRSENAEYIYGKRRLREIDRRVRFLTKRLEVLQIVDYNPKQEGKVFFGAWVELENEEGEIKQYRIVGCDEFAPAKNWISIDSPVARALIGKTLDDEVRVETPSGFITLYINKIWYEK

SEQ ID NO: 3212 - protein, 205 aa, H. influenzae strain 86-028NP
MAGVRAVQKEKTRRALVDAAFNQLSAEKSFSNLSLREVAREAGIAPTSFYRHFSDMDELGLEMVDEAGLMLRQLMRQARKRIDAGGSVISVSVDTFFEFITNSTNVFRLLLRESSGTSQAFRTAAAREIKHFVDELAEYISYKHQYSQYVAYVQAEGIVTIVFTAGANALDMSKAEREQLKARVILQLRMLAKGADFAANKERGK

SEQ ID NO: 3213 - protein, 301 aa, H. influenzae strain 86-028NP
MNIRDLEYLVALSEYKHFRRAADSCNVSQPTLSGQIRKLEDELGIILLERTSRKVLFTQSGMLLVDQARTVLREVKLLKEMASNQGKEMTGPLHIGLIPTVGPYLLPYIVPMLKAAFPDLEVFLYEAQTHQLLEQLETGRLDCAIVATVPETEAFIEVPIFNEKMLLAVSEHHPWAQESKLPMNQLNGQEMLMLDDGHCLRNQALDYCFTAGAKENSHFQATSLETLRNMVAANAGITFMPELAVLNEGTRKGVKYIPCYSPEPSRTIALVYRPGSPLRNRYERVASAVSDEVKSILDGLK

SEQ ID NO: 3214 - protein, 241 aa, H. influenzae strain 86-028NP
MSSMEGKKVPQVTFRTRQGDKWVDVTTSELFDNKTVIVFSLPGAFTPTCSSSHLPRYNELAPVFKKYGVDDILVVSVNDTFVMNAWKEDEKSENITFIPDGNGEFTEGMGMLVGKEDLGFGKRSWRYSMLVKNGVVEKMFIEPNEPGDPFKVSDADTMLKYLAPQHQVQESISIFTKPGCPFCAKAKQLLHDKGLSFEEIILGHDATIVSVRAVSGRATVPQVFIGGKHIGGSDDLEKYFA

SEQ ID NO: 3215 - protein, 73 aa, H. influenzae strain 86-028NP
MQIQQMLENRIEELEMKIAFQEQLLDELNHALVQQQFDIDKMQVQLRYMANKLKDFQPSNIASQSEETPPPHY

SEQ ID NO: 3216 - protein, 241 aa, H. influenzae strain 86-028NP
MLKIQKLSIAALMVSAVISGQVFAEDNTFDEKAASYAVGTLMGSQMKDLVDSHKEVIKYDNARILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 3217 - protein, 221 aa, H. influenzae strain 86-028NP
MTLNDKYPFTDEDQAIINSYKAVVDGVSALIGEHCEIVLHSLENIEHSAICIANGHNTNRQVGSPITDLALRSLRNMQSESVSKPYFTRAKGSVLMKSVTIAIRNKTQRIIGLLCININLDVPMSQFLQCFMPTEHTNETSSVNFANSVEDLVAQTIEKTIEEVNADRAVANNTKNRQIVLSLYEKGIFDIKDAINLVAERLDISRHTVYLYIRQIKQEQE

SEQ ID NO: 3218 - protein, 126 aa, H. influenzae strain 86-028NP
MRYVIAVKSPIYGKQGAFLAYQFANALIKKGHEISQIFFFQDGVSNGNALVYPANDEVNLQKHWQMFSITHNVPLHLCVAASQRRGVVDNLTTPTTAHYNLAEGFIIAGLGEFIAASLNADRVITL

SEQ ID NO: 3219 - protein, 119 aa, H. influenzae strain 86-028NP
MKIAFLFRTSPHGTSISREGLDAILAATAFCEPNDIGIFFIDDGVLNLIDNQQPEIIQQKDFIRAFKLLDLYDVEQRFICTASLQKFKLDNRELILSCEKIDRSLLLEKLNQAEKLFTF

SEQ ID NO: 3220 - protein, 95 aa, H. influenzae strain 86-028NP
MLYTFSQSDYPKTELDDYFSYITEKDAVVLWQDGVLLAIKYPDYFAKCKGNCMILKQDILARNLTALLPQSSKIKLISIEELVGITENYLPQLSL

SEQ ID NO: 3221 - protein, 394 aa, H. influenzae strain 86-028NP
MSKEKFERTKPHVNVGTIGHVDHGKTTLTAAITTVLAKHYGGAARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALQALNGVAEWEEKILELAGHLDTYIPEPERAIDQPFLLPIEDVFSISGRGTVVTGRVERGIIRTGDEVEIVGIKDTAKTTVTGVEMFRKLLDEGRAGENIGALLRGTKREEIERGQVLAKPGSITPHTDFESEVYVLSKDEGGRHTPFFKGYRPQFYFRTTDVTGTIELPEGVEMVMPGDNIKMTVSLIHPIAMDQGLRFAIREGGRTVGAGVVAKIIK

SEQ ID NO: 3222 - protein, 307 aa, H. influenzae strain 86-028NP
MNLTPFLSFNRKQWAELRKSVPLKLTEQDLKPLLGFNEELSLDEVSMIYLPLARLINYYIDENLRRQAVLHRFLGRNKTKVPYIISIAGSVAVGKSTSARILQSLLSHWPAERKVDLITTDGFLYPLEKLKKDHLLHKKGFPISYDTPKLIHFLADVKSGKTEVEAPIYSHLTYDIIPDKFNVINKPDILILEGLNVLQTGNNKTNQTFVSDFVDFSIYVDAEEKLLKEWYIKRFLKFRESAFNDPNSYFKHYANLSKEESITTASKIWDEINGLNLNQNILPTRERANLILKKGHNHQVELIKLRK

SEQ ID NO: 3223 - protein, 315 aa, H. influenzae strain 86-028NP
MKKIALKFTALSLSLLLSSIASAEELSAKQSLDKMTQALDNLNYEIAFVQTTPANMDSFRYRHIKQDNKTYAQLVTLDGRQQEIIQRDNLVSYFQPNAQAFTLNSGNIVDAMPAVVRANFDKLSSDYDFVKLGKDRVAGRFADTIRIVPKDDFRYQYLVFIDEENGLLLRSDMLDREGKLLDQFRVVTLYIDDRLRGLTDYINKVSLPPLLKESKNEQSSDITWSAGWLPQGFSLIRYTQEILENEIIDSALYSDGLFTFTLFVSNVSSNDLPENTWKQGAYTIYSEVIGGKEITFIGQLPISTAKRIVQEVKFR

SEQ ID NO: 3224 - protein, 191 aa, H. influenzae strain 86-028NP
MQKEQLSAYMDGEQVKTDLTDALLRDEELQASWHSFHTVRSVMRKESAVFLGGDFTAKMADLIELEDVKKVDVIAVSQPEPEDAHNSAFMQKLKAFFAPMTQVAVAAGVCLVAVLGVQSFNSKNEASNLPEAPVLQTLPFNNAVQEVSYNAPSKDTLTSDQLEKKSRRIGAMLQNYELQRRMHSDASSQVR

SEQ ID NO: 3225 - protein, 189 aa, H. influenzae strain 86-028NP
MAEQLTDQALVERVQQGDKKAFNLLVSRYQNKVAGLLTRYVSRNDIPDVVQESFIKAYRSIESFRGESAFYTWLYRIAVNTAKNYLTAQGRRPPNEDILAEDAENYDVGTHLRDVDTPENEMLSSELERIVFDTIHNLPEDLKTAITLRELEGLSYEEIAEIMDCPVGTVRSRIFRAREMIENKIQPLM

SEQ ID NO: 3226 - protein, 85 aa, H. influenzae strain 86-028NP
MEKYNKLRIEWDCRRGMLELDKIIMPFYLKHFDELTDDKKDIFIRLLASTDLQLFSWFFNRGKSSDSEIQSMVEYIQNVQKITTN

SEQ ID NO: 3227 - protein, 128 aa, H. influenzae strain 86-028NP
MNFIKEFREFAMRGNVVDMAIGVIIGSAFGKIVSSLVSDIFTPVLGILTGGIDFKDMKFVLAQAQGDVPAVTLNYGLFIQNVIDFIIIAFAIFMMIKVINKVRKPEEKKTAPKAETLLTEIRDLLKNK

SEQ ID NO: 3228 - protein, 458 aa, H. influenzae strain 86-028NP
MKIIILGAGQVGTTLAENLVSEDNDITLVDNESPQLQTLQEKHDLRVVQGSPSSPKVLRDAGAADADLMVAVTASDEINMVACQMGYTLFNTPTRIARIRNSEYLREKDKLFNNENIPIDHLISPENLVTDEITRLIAYPGALQVAHFANNRISIVVVKAYYGGALVGYALSAFREHMPHIDCRIMSILRNGKPIRPQGSTIVEAGDEITFICATEHIKAVMGELQRLEKPYKRVMIVGGGNVAFGVAKRLENSCTVKLIERDSNRAQALAEKLPKTLVFNGDASDQNLLFEEHIESVDVFLSLSSDDEANIMSALLAKRLGAKKAMVLIQRIAYINLIQGGTIDIAVSPQQVTISALLGHVRKGDVKNVATLRHGIAEAIEIVAHGNVNTSNIVGRKIGELRLPMGTIIGALLRGNDVIIARRQVIIEEGDHIVIYLSDKKNVPEIEKLFQPSAFFI

SEQ ID NO: 3229 - protein, 450 aa, H. influenzae strain 86-028NP
MKKFSSKTIKVKNSVKMTALSTRAIAANLILQALDEGKSLSALIPEVQLSVKAQDLPLLQEICFGVCRVLPRLEQIIKRLVDKPLKGKTRIVHCLLLVGLYQLLYMRVPAHAAVDEVVNATKSLKSDSFRGLVNAVLRRFLREQDEILAIIDKNWQTLHPEWFVNKLKKAYPNWREIIEANNQKPPMWLRVNSQKNALETYRTLLEEQGISAKTSHHPNALCLDIPIAVQKLPHFEEGAVTVQDLSAQWAAMLLEPKNEEWILDACAAPGGKTTHILELAPQANVIALDVESHRLKRVEENLARLNQQAIVVCGDASKPDEWLAEIGKSAVKFDRILLDAPCSATGVIRRHPDIKWLRKETDIAQLVELQKKILSALWEKLKPNGVLLYATCSVLPEENCEQIQAFLNAHADAELLPLPVSDDKSAVGFQFIPQPNSGDGFYYAKLLKRA

SEQ ID NO: 3230 - protein, 318 aa, H. influenzae strain 86-028NP
MKSLNIIFAGTPDFAAQHLQAILNSQHNVIAVYTQSDKPAGRGKKLQASPVKQLAEQNNIPVYQPKSLRKEEAQSELKALNADVMVVVAYGLILPKAVLDAPRLGCLNVHGSILPRWRGAAPIQRSIWAGDVQTGVTIMQMDEGLDTGDMLHKVYCDILPTETSTSLYNKLAELAPSVLIDVLDNLENSKFIAEKQDGSQSNYAEKLSKEEAQLDWSLPAMQLERNIRAFNPWPIAYFSTEDKDGNAQTLKVYQAEVLPHQDKPAGTILSADKNGIQIATVDGVLNLLQLQPAGKKPMSAQDLLNGRAEWFTIGKVLA

SEQ ID NO: 3231 - protein, 169 aa, H. influenzae strain 86-028NP
MTALNVLIYPDDHLKVVCEPVTEVNDAIRKIVDDMFDTMYQEKGIGLAAPQVDILQRIITIDVEGDKQNQFVLINPEILASEGETGIEEGCLSIPGFRALVPRKEKVTVRALDRDGKEFTLDADGLLAICIQHEIDHLNGILFVDYLSPLKRQRIKEKLIKYKKQIAKS

SEQ ID NO: 3232 - protein, 145 aa, H. influenzae strain 86-028NP
MEGEFMSNFFNSLFSDKGEIKGIDNQYSVSEIVDILKEEGYSINVIQDNFLVFRLQGTNVVVVPHDGGDIQFFIMYDDDENRFSLRKVNKINIDYRLGKFYLTDDDKLGIELLLRNDGNGVTKSQIIQGLSDISLLNGLAKKEFW

SEQ ID NO: 3233 - protein, 61 aa, H. influenzae strain 86-028NP
MLIPIFENGKKIYQDSSGNKYQYDLTNSMDQFSYSTDLSAQMRDKSSITATRNPNGGGIYE

SEQ ID NO: 3234 - protein, 217 aa, H. influenzae strain 86-028NP
MNIKDEHIDSVCSLLDQLVGNVSFKNLFTGYGLFHKEETMFAIWQNKKLYLRGEGVLAIQLTKLGCEPFTTNELNKRFVLSQYYALSDQILRSNRLCRKLIILSIKQILERKLECTLRKLNRLKDLPNLTIKHERALIKVGITNVAMLREIGAENALVELKKSGSGATLDFYWKLVCALQNKNSQMLSQAEKERLLKKLNEVLRKNGLKGYRKLDDE

SEQ ID NO: 3235 - protein, 354 aa, H. influenzae strain 86-028NP
MATQEEKQKALAAALGQIEKQFGKGSIMKLGDTKTLDVESISTGSLGLDVALGIGGLPMGRIVEIFGPESSGKTTLTLSVIAQAQKAGKTCAFIDAEHALDPIYAAKLGVDVKELFVSQPDNGEQALEICDALVRSGAIDVIIVDSVAALTPKAEIEGDMGDSHMGLQARLMSQALRKLTGQIKNANCLVVFINQIRMKIGVMFGNPETTTGGNALKFYSSVRLDIRRTGSVKDGENIIGNETRVKVVKNKLAAPFRQVDFQILYGEGISKAGELLELGVKHKLVEKSGAWYSYNGEKIGQGKANSMKWLNENIEKSDELEARLRAELVANPEQALMADIEQSENNTESESDFE

SEQ ID NO: 3236 - protein, 152 aa, H. influenzae strain 86-028NP
LSSLAFNYIVNLLSRREYSEFELRNKMQEKNFSEEEIDDALSLCQAKNWQSDRRFSENYLNSRSQKGCGVGRIRQELRQLKGVSSDIIDEVLMESEIDWYEMAENLLRKKFPNYNEQQTSKMKQKIWQYMLSHGFRSDEFADLIGQNQSEWD

SEQ ID NO: 3237 - protein, 128 aa, H. influenzae strain 86-028NP
MQALLFISYGAILGASLRWAIGLLFNPLFSSFAFGTLIANLLGCLIIGVLLGFFWQFPQISSEWRLFLITGFLGSLTTFSSFSSEVVELFFNDKWLNGFCVLMMHLFGCLAMTVLGIWIYKICSQLLS

SEQ ID NO: 3238 - protein, 272 aa, H. influenzae strain 86-028NP
MNLPFRAMVSDLDGTLLTPEHLVGDLTIDTLRALEQKGVDIILATGRNHTDVSSILGKIGAERAVMITSNGARVRDLQGNLLYSNSLPEELVLELYKTPFDTSKVCMNSYQDEGWFTNKDIPAMRQFHKESGFDYNVVDFSKHHGRGTEKVFFIGKTPEDLVAVETYLRDKFGDVTTIVYSALACLEVMNKNVSKGDALKHLLESREYQLKDCIAFGDGMNDVEMLSWAGTGCIMKDADIRLKMACPELEVIGSNKEESVARYLRTLFGLDY

SEQ ID NO: 3239 - protein, 334 aa, H. influenzae strain 86-028NP; identical to SEQ ID NO: 626

SEQ ID NO: 3240 - protein, 310 aa, H. influenzae strain 86-028NP
MRIVIALGGNALLRRGEPMTAENQRQNVRIACEQIAKIWPNNELVIAHGNGPQVGLLALQGAAYTDVPTYPLDVLGAETAGMIGYMIQQELGNLVPFEVPFATLLSQVEVDINDPAFKNPTKPIGPVYTKEEAERLAKEKNWSIAQDGDKYRRVVPSPLPKRIFEIRPVKWLLEKGSIVICAGGGGIPTYYDEHHNLQGVEAVIDKDLCSALLAENLDADLFIIATDVSATFVDWGKPNQKAISVASPEAISELGFASGSMGPKVQAAINFAKQTGKDAVIGSLSDIVDIVKGKAGTRITKKAEGISYYA

SEQ ID NO: 3241 - protein, 509 aa, H. influenzae strain 86-028NP
MDASKKKKTFNFPSAFTILFAILILAVGLTWVIPSGSYSKLTYNSTDNVFVVKAYGVDDKTYPATTDTLDNLNIKIKLSNFTEGVIKKPIAIPGTYQRVEQHHKGIEDITKSMVEGTIEAVDVMVFIFVLGGMIGVINRTGSFNAGLMALVKKTKGNEFFIVFCVSVLMVLGGTTCGIEEEAVAFYPILVPVFLALGYDAIVCVGAIFLAASMGTAFSTINPFSVVIASNAAGIQFTEGIGFRALGLVLGATCVIAYLYWYCKKIKADPSFSYTYDDREEFRQRYMKNFDPNTTIPFSARRKLILTLFCISFPIMIWGVMVGGWWFPQMAASFLAITIIIMFISGLSEKDVVESFTEGASELVGVSLIIGLARGVNLVLEQGMISDTILDYMSNVVSGMPGSVFILGQLVVFIFLGLIVPSSSGLAVLSMPIMAPLADSVGIPRDIVVSAYNWGQYAMLFLAPTGLVLVTLQMLHIPFDRWVKFVMPMIGCLLLIGSILLVVQVSLYSV

SEQ ID NO: 3242 - protein, 1025 aa, H. influenzae strain 86-028NP
NQPTNQPTNQPTNQPTNQPTNQNSNASEQLEQINVSGSTENTDTKTPPKIAETVKTAKTLEREQANNIKDIVKYETGVTVVEAGRFGQSGFAIRGVDENRVAITVDGVAQAETLSSQGFKDLFEGYGNFNNTRNGIEIETLSDAKITKGADSLMSGSGALGGSVIYKTKDARDLLLNKNYAFKYKTGFTSENDERLNSITFAGKASIFDVLAVGTWRNGHEIKNYDYKSADDILGKLREKTDPYNKKDRSLLLKIGTNLGENNRIAVAYDRRRVENKGLDKSYSLHGCTKYVCDDNEIDTRHTHDESIRTSKSIAFENTNINPLWDTLKLSYTDQSITQRARSDEHCDGERCPGVQNPIGLHYNNDNKLVDKNNNPVTYKLENRSVTYYSYIDESIFNRYSNFKEEVPVELAKEWKLKEYGGKYYIDSPRCFKNHGDANHEGMCRLRSDVKEEKETLVANNITYDLKKEYFINSRLTNSDNLLSCDGINCDKGTIQGFEADGTPKDLPIKIIPKEGKKFALIEKISDQNGYNIGPEKASRFLVPNSPGYNRNIWKKRDLDTRTQQINLDLTKHFELGKSQHDLSYGLVWSKTTKSMINKEGLKVNSGKWWIDYPKDCESSTSDLCTKNSTASFLIPVETKDGSLYFKDEFRVNDRLGLDIGYRYDKVKYKTNYQPGITPKIPDDMLVNLFIKEPFVKNTRSLNPNDPNEINRRKNAEANINYISQPKKFNASSYALSTKFDPLDWLQVQAKYSKGFRAPTADELYFTFKHPEFTVLPGSKLKPEIAKTKELSLTLHDDEIGFISGGYFITNYNNFIDFSYLGTKSFGSQATKHELYQSVNLDNAKVTGFELKTKFTLGKWISWLKNVDFGYQLTKQKGKASDNRPLNAIQPMTQVMSLAYTHPDNLFGANLYLTHVSQKEASDTYNIYSKDATAGDKEYVQNKHIKWRSKAYTVTDFTFFVKPMKNLTLRAGVYNLFDKKYMTWDSARSIRMFGTSNLINQETGAGINRFYAPGKNYRMSVQFEF

SEQ ID NO: 3243 - protein, 234 aa, H. influenzae strain 86-028NP
MKNMLLLSSSKYKNTGYLEHTLPWLQNFLADYRGKTIAFVPYAGVSRTFDEYEKTVQNALSDLGMNIVSVHHGKQHRDIIEQADVISIGGGNTFCLLKQLYEHNLIDIIREKVNNGTPYFGWSAGANVAGASIMTTNDMPITYPPSFQALQLFPHQINPHFISGKMQGHNGESREERLAEFLLVNPTALVYALPEGSALHIQNEMATVLGENPILCFSENMECGTFDINTTFSY

SEQ ID NO: 3244 - protein, 431 aa, H. influenzae strain 86-028NP
MELFKSIVAVIGIIATIYFLIKKAETRTVLIGVGLIMSILTLNPMGALDAFAKSMTSGGLIMAICSSMGFAYVMKYTQCDTHLVHLLTKPLSGLKFFLIPIATVITFFINIAIPSAAGCAAAVGATLIPVLKSAGVRPATAGAAILAGTFGSMMSPGSSHSAMISEMSGLTITQVNLSHAPYNMIAGAIGAVVLTILALVFKDYGEQHRQAYLAEQKESEIKVVEGVNVLYALAPLIPLVILVIGGTSLQQVPGLEWTKMGVPQAMLIGAIYGIIVTRISPVKITEEFFNGMGNSYANVLGIIIAASVFVAGLKSTGAVDAAISFLKESNEFVRWGATIGPFLMGLITGSGDAAAIAFNTAVTPHAVELGYTHINLGMAAAIAGAIGRTASPIAGVTIVCAGLAMVSPVEMVKRTAPGMILAVLFLALFML

SEQ ID NO: 3245 - protein, 423 aa, H. influenzae strain 86-028NP
MNLDLNQLVKWRREFHRFPEIGWSEFWTTSRIADYLEDLDCFEIFLGKQIINPDFVRGRKQAVVDKGLANAKAYGANEKWLEKMEGYTGCVALFDSGKPGKTIALRFDIDCVNVTETRSPEHIPNKEGFASINDGFMHACGHDSHITIGLGVALWIAQNKDKLTGKVKIVFQPAEEGVRGAAAIAQSGIIDDADYFASSHISFCANTGTVIANPRNFLSTTKIDIRYKGKPAHAGAAPHLGRNALLAAAHTVTQLHGIARHGEGMTRINVGVLKAGEGRNVIPSSAELQLEVRGENKAINEYMTEQVMQIAKGISISFDVAYETEIVGEAVDMNNDVELIKLIEEISLKQPQINNVNSDYAFNASEDATILGRRVQEHGGKAIYFILGADRTAGHHEAEFDFDENQLLTGVNIYTSLVQKLLS

SEQ ID NO: 3246 - protein, 657 aa, H. influenzae strain 86-028NP; identical to SEQ ID NO: 687

SEQ ID NO: 3247 - protein, 135 aa, H. influenzae strain 86-028NP
LLEEIMKINELSKSTHTNIETIRYYEKQGVLPPPKRLANGYRFYDEESIEQLNFIKKCRMLGFSLENIRELNRIRFSTKDHYQADQLVLNQLIQVENKISQLLEIKAFLQSIVTENEHNEEECKAIEGLKSECNL

SEQ ID NO: 3248 - protein, 225 aa, H. influenzae strain 86-028NP; identical to SEQ ID NO: 717

SEQ ID NO: 3249 - protein, 629 aa, H. influenzae strain 86-028NP
MFYTETYDVIVIGGGHAGTEAALAPARMGLKTLLLTHNVDTLGQMSCNPAIGGIGKGHLVKEVDAMGGLMAHAADKAGIQFRTLNSSKGPAVRATRAQADRVLYRQAVRTALENQPNLDIFQQEATDILIEQDRVTGVSTKMGLIFRAKSVVLTAGTFLAGKIHIGLENYEGGRAGDPASVNLSYRLRDLGLRVDRLKTGTPPRIDARTINFDILAKQHGDAVLPVFSFMGSVSDHPQQIPCYITHTNEQTHEVIRNNLDRSPMYTGVIEGIGPRYCPSIEDKVMRFADRNSHQIYLEPEGLTSNEVYPNGISTSLPFDVQMGIVNSMKGLEKARIIKPGYAIEYDYFDPRDLKPTLETKAISGLFFAGQINGTTGYEEAAAQGLLAGINAGLYVQEKEAWYPRRDQSYTGVLVDDLCTLGTKEPYRVFTSRAEYRLLLREDNADIRLTPIAHELGLIDEARWARFNQKMEKIEQERQRLRSIWLHPRSEYLEEANKVLGSPLVREASGEDLLRRPEMTYDILTSLTPYKPAIEDREAVEQVEIAIKYQGYIEHQQEEIEKQKRHENTAIPANFDYSKVSGLSNEVRAKLEQHRPVSIGQASRISGITPAAISIILVNLKKQGMLKRGE

SEQ ID NO: 3250 - protein, 124 aa, H. influenzae strain 86-028NP
MATINQLVRKPRVKKVVKSNVPALEACPQKRGVCTRVYTTTPKKPNSALRKVCRIRLTNGFEVTSYIGGEGHNLQEHSVVLIRGGRVKDLPGVRYHTVRGALDCAGVKDRKQGRSKYGVKRPKA

SEQ ID NO: 3251 - protein, 156 aa, H. influenzae strain 86-028NP
MPRRRSVEARKILPDPKFGSELLAKFINVIMVDGKKSVAESIVYGALETLAQRTGKEPLEAFEVALENVRPTVEVKSRRVGGSTYQVPVEVRPVRRNALGMRWIVEAARKRGDKSMALRLANELSDASDNKGAAVKKREDVHRMAEANKAFAHYRW

SEQ ID NO: 3252 - protein, 700 aa, H. influenzae strain 86-028NP
MARTTPIERYRNIGISAHIDAGKTTTTERILFYTGVSHKIGEVHDGAATMDWMEQEQERGITITSAATTAFWSGMSQQFPQHRINVIDTPGHVDFTVEVERSMRVLDGAVMVYCAVGGVQPQSETVWRQANKYEVPRIAFVNKMDRTGANFLRVVEQLKTRLGANAVPLQLPIGAEENFTGVVDLIKMKAINWNEADQGMTFTYEEVPANMQADCEEWRQNLVEAAAEASEELMEKYLGGEDLTEEEIKSALRQRVLANEIILVTCGSAFKNKGVQAMLDAVVEYLPAPTDIPAIKGINPDETEGERHASDEEPFSSLAFKIATDPFVGNLTFFRVYSGVINSGDTVLNSVRQKRERFGRIVQMHANKREEIKEVRAGDIAAAIGLKDVTTGDTLCAIEAPIILERMEFPEPVISVAVEPKTKADQEKMGLALGRLAQEDPSFRVHTDEESGETIISGMGELHLDIIVDRMKREFKVEANIGKPQVSYRETIRTRVNDVEGKHAKQSGGRGQYGHVVIDLYPLDPEGPGYEFVNEIKGGVIPGEYIPAVDKGIQEQLKSGPLAGYPVVDLGVRLHFGSYHDVDSSELAFKLAASLAFKAAFSKANPVLLEPIMKVEVETPPEYVGDVIGDLSRRRAMVNGQEANEFVVKIDAEVPLSEMFGYATDLRSQTQGRASYSMEPLKYAEAPTSVAAAVIEARKK

SEQ ID NO: 3253 - protein, 394 aa, H. influenzae strain 86-028NP
MSKEKFERTKPHVNVGTIGHVDHGKTTLTAAITTVLAKHYGGAARAFDQIDNAPEEKARGITINTSHVEYDTPTRHYAHVDCPGHADYVKNMITGAAQMDGAILVVAATDGPMPQTREHILLGRQVGVPYIIVFLNKCDMVDDEELLELVEMEVRELLSQYDFPGDDTPIVRGSALQALNGVAEWEEKILELANHLDTYIPEPERAIDQPFLLPIEDVFSISGRGTVVTGRVERGIIRTGDEVEIVGIKDTAKTTVTGVEMFRKLLDEGRAGENIGALLRGTKREEIERGQVLAKPGSITPHTDFESEVYVLSKDEGGRHTPFFKGYRPQFYFRTTDVTGTIELPEGVEMVMPGDNIKMTVSLIHPIAMDQGLRFAIREGGRTVGAGVVAKIIK

SEQ ID NO: 3254 - protein, 114 aa, H. influenzae strain 86-028NP
LNSAKLFGKFLLPFWLCLSVYQLGVLATGFILVAIQGNSPYFPRYQGATSVSCLYLWLAICGVGYGILGGIFGRLLAKGIAGLSPEKWRGWVRQHPIYIALLLGLVLAALLEWK

SEQ ID NO: 3255 - protein, 60 aa, H. influenzae strain 86-028NP
VEMTGAQLVLIWLLISSIIASIISRQFSPKPFYHFAAGRFRQQMQARQAEELRSKTKQEK

SEQ ID NO: 3256 - protein, 327 aa, H. influenzae strain 86-028NP
MPQNLPHFYRGRFSVAPMLDWTTRHCRYFHRQFSKHALLYTEMVTAPAIIHAKYDHLDFDLQENPVALQLGGSDPEQLKYCAKLAEERGYHEINLNVGCPSDRVQNGMFGACLMAKADLVADCVEQMQSAVKIPVTVKTRIGIDELDSYEFLCDFIEKVQGKGCQEFIIHARKAWLSGLSPKENREIPPLDYARVYQLKRDFPHLTIAINGGIKTIEEMKQHLQYVDGVMVGREAYQNPSLLGQIDQALFDPNAAIVTAHEAVQSMLPYIEQQLNQGIHLNHIVRHMLGAFQNCKGARQWRRYLSENAFKQGAGVEVIETALSFVEH

SEQ ID NO: 3257 - protein, 96 aa, H. influenzae strain 86-028NP
MAIQTEKPIECVGCNTFDMKSLFDNRDCSQVIEYIYDSEEQAQEALAFFTQKARDVESEPCEIQSEITKLDDGYLLKADFTFCCQAELVIFQMRIA

SEQ ID NO: 3258 - protein, 336 aa, H. influenzae strain 86-028NP
LIMAKPIVFSGVQPSGELTIGNYLGALRNWVKMQEDYECIFCVVDLHAITVRQDPVALRKATLDVLALYLACGIDPNKSTIFVQSHVPEHTQLSWVLNCYTYFGEMSRMTQFKDKSARYAENINVGLFDYPVLMAADILLYQAKSVPVGDDQKQHLEITRDIANRFNALYGNIFTIPEIFIGKAGARIMSLQDPEKKMSKSDDNRNNVVTLLEDPKSVAKKIKRAVTDSDEPPVVRYDVQNKAGVSNLLDILSAVTDKPIADLEKEFEGKMYGHLKTAVADEVSTLLAGLQERFHQYRNDETLLDNILRQGAEKARAKAQETLAKVYEAVGFVAAK

SEQ ID NO: 3259 - protein, 205 aa, H. influenzae strain 86-028NP
MKNYHDIVLALAGVCQSAKLVHQLATESRADSDTFLTALNSLFITQPQRIEDVFGGEVRHLKLGLETLIHQLNAQGDQNLTRYWLSLLALEGKLSKNSDAKQTLGNRISRLKEQEIHYARDSETMLSIMANIYSDIISPLGKKIHILGSPDYLRQELVQNKIRAVLLAGIRSAVLWKQMGGTKWQILFFRRKLLATAKQIYSSIY

SEQ ID NO: 3260 - protein, 456 aa, H. influenzae strain 86-028NP
MQLSTLTALSPLDGRYQDKVTPLRAIFSEFGLMKFRVVVEVRWLQKLASTADITEVPPFSTQANAFLDGIVANFNEADAARIKEIERTTNHDVKAVEYFLKEKIQNEVELVNVSEFIHFACTSEDINNLSHALMLSTARDEVILPEWQKLIDEITRLAEEYKTIPLLSRTHGQPASPSTVGKEMANVVYRLKRQFKQLQNAEILGKINGAVGNYNAHLSAYPNIDWHKFSEEFVTSLGIQWNPYTTQIEPHDYIAEFFDAVVRFNTIIIDFDRDLWGYIALNHFKQRTIAGEIGSSTMPHKVNPIDFENSEGNLGLANAVMTHLGQKLPISRWQRDLTDSTVLRNLGVGLGYCLIAYASTRKGMSKLEVNQPHLLEELNQNWEVLAEPIQTVMRRYGIEKPYEKLKELTRGKRVTEQAMREFIDKLDIPQEEKLRLQKLTPATYIGAAVELVEKLS

SEQ ID NO: 3261 - protein, 163 aa, H. influenzae strain 86-028NP
MALNLQDKQAIVAEVNEAAKGALSAVIADSRGVTVEKMTELRKSAREAGVTMRVVRNTLLRRAVEGTDYECLKDTFVGPTLIAFSNEHPGEAARLFKEFAKANDKFEIKGAAFEGKIQDVEFLATLPTYEEAIARLMGTMKEAAAGKLARTFAALRDKLQEAA

SEQ ID NO: 3262 - protein, 123 aa, H. influenzae strain 86-028NP
MSLTNEQIIEAIASKTVTEIVELIAAMEEKFGVSAAAAVAAAPAAGGAAAAEEKTEFDVVLKSAGANKVAVIKAVRGATGLGLKEAKDLVESAPANLKEGVSKEEAEALKKELEEAGAEVEVK

SEQ ID NO: 3263 - protein, 456 aa, H. influenzae strain 86-028NP
MTKKALSAVILAAGKGTRMYSDLPKVLHTIAGKPMVKHVIDIAHQLGSENIHLIYGHGGDLMRTHLANEQVNWVLQTEQLGTAHAVQQAAPFFKDNENIVVLYGDAPLITKETLEKLIEAKPENGIALLTVNLDNPTGYGRIIRENGNVVAIVEQKDANAEQLNIKEVNTGVMVSDGASFKKWLARVGNNNAQGEYYLTDLIALANQDNCQVVAVQATDVMEVEGANNRLQLAALERYFQNKQASKLLLEGVMIYDPARFDLRGTLEHGKDVEIDVNVIIEGNVKLGDCVKIGAGCVLKNVVIGNDVEIKPYSVLEDSIVGEKAAIGPFSRLRPGAELAAETHVGNFVEIKKSTVGKGSKVNHLTYVGDSEIGSNCNIGAGVITCNYDGANKFKTIIGDDVFVGSDTQLVAPVKVANGATIGAGTTITRDVGENELVITRVAQRHIQGWQRPIKKK

SEQ ID NO: 3264 - protein, 103 aa, H. influenzae strain 86-028NP
MKKQSLPTKFSPFAWGLAAFCSPILLCPMALLISTAFSKNPYLSSWQINLFSTLFWVYPFILAVTARMLYRLHQHKPKLANKLLTLSAVIFYVILITICKIGL

SEQ ID NO: 3265 - protein, 311 aa, H. influenzae strain 86-028NP
MIREPYFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKVTALFSYSTQHLLAHSMGALIATYYLANYDHHINKAVLSSPFYGILLKHPIRDELIIALMNILGQGERYVFGKGPYQQAHLEYNELTFCKTRMKWMNRVNRKNPAINLGGPTFRWVHLCLNAIKRLPKVIPKIEIPILILQAEKEKIVDNNNLEKLTVLFPNARCEVVFNAKHEILFEQDKLRKETIFKILEFLNN

SEQ ID NO: 3266 - protein, 371 aa, H. influenzae strain 86-028NP
MKNVGFIGWRGMVGSVLMDRMSQENDFANLNPVFFTTSQAGQKAPVFGGKDAGDLKSAFDIEELKKLDIIVTCQGGDYTNEVYPKLKATGWDGYWVDAASALRMKDDAIIVLDPVNQHVISEGLKKGIKTFVGGNCTVSLMLMAIGGLFEKDLVEWISVATYQAASGAGAKNMRELLSQMGLLEQAVSSELKDPASSILDIERKVTAKMRADNFPTDNFGAALGGSLIPWIDKLLPETGQTKEEWKGYAETNKILGLSDNPIPVDGLCVRIGALRCHSQAFTIKLKKDLPLEEIEQIIASHNEWVKVIPNDKETTLRELTPAKVTGTLSVPVGRLRKLAMGPEYLAAFTVGDQLLWGAAEPVRRILKQLVA

SEQ ID NO: 3267 - protein, 238 aa, H. influenzae strain 86-028NP
MENSSLLLTALFNPDHLIIFSKMLLAMVLGSVIGLERELKRKPVGVKTCAIIAVTTCVLTIVSIQAAEHYAQVSENIRTDPMRLAAQVISGIGFLGAGVILHKKNDAISGLTTAAIIWASAGIGIAAGAGFVFDAVIATVMILVSIRLSPLVQRWVHRKSQRRRTKFNILVNDAESIGKVTQLLVNNQYRIEHIQVKDQSSGEVRLQIRCFSIDSTMLKDAYALLKAEDGVISVEVDN

SEQ ID NO: 3268 - protein, 218 aa, H. influenzae strain 86-028NP
LPKKLGIWVRLHYVYPYPHVDDLIPLMADGTLLPYLDIPLQHASPKILKAMKRPGSIDRTLERIKQWREICPDLTLRSTFIVGFPGETEEDFQLLLDFLKEAQLDRVGCFKFSPVEGAPATDMADQVPEDVKEERFHRFMQLQQEISANRLKQKIGKTLDVLVDEIDEDGIIGRSKADAPEVDGLVYVDNLSGINVKVGDVIKVTITNSDEYDLWGSC

SEQ ID NO: 3269 - protein, 192 aa, H. influenzae strain 86-028NP
MNILLLDGGKAFGHSHGELNHSLHKKAKEVLTALGHNVKETVIDAGYDVEAEIEKFLWMDAVIWQMPSWWMHEPWTVKKYIDEVLTSGHGKLYHSDGRHSVNPTEGYGTGGLLQGKKHMLSLTWNAPIEAFTREGDFFEGKGVDVLYMHFHKLNEFIGLTRLPTFLCNDVVKSPQVEQYLADYQAHLEKVFG

SEQ ID NO: 3270 - protein, 670 aa, H. influenzae strain 86-028NP
MKLNPQQQQAVEYVTGPCLVLAGAGSGKTRVIINKIAHLIEKCGYSPKQIAAVTFTNKAAREMKERVAHSIGKEQSKGLLVSTFHTLGFDIIKREYKALGFKSNMTLFDEHDQFALLKELTADVLKEDKDLLRELISVISNWKNDLISPKQAFALARDAKYQTFAKCYERYATQIRAYNALDFDDLIMLPTLLFKQNEEVRSKWQAKIRYLLVDEYQDTNTSQYELIKLLVGERACFTVVGDDDQSIYSWRGARPENMVRLRDDFPRLNVIKLEQNYRSTQRILHCANILIDNNEHVFDKKLFSTIGTGEKLLVIEAKNEEHEAERIVAELIAHRFSRKTKYKDYAILYRGNHQSRLLEKVLMQNRIPYKISGGTSFFSRAEIKDMMAYLRLVVNQDDDGAFLRIVNTPKREIGTATLQKLGELAQEKHISLFDAIFEFELIQRITPKAYDSLQKFGRWIVELNDEIQRSEPERAVRSMLSAIHYEEYLYEYATNPKAAEMQSKNVATLFDWVADMLKGDETNEPMNLNQVVTRLTLRDMLERGEDDDDSDQVQLMTLHASKGLEFPYVYLIGMEEGILPHQTSIDEDNVEEERRLAYVGITRAQKELTFSLCRERRQYGELVRPEPSRFLAELPNDDVLWERDKPKLTTEQKQEKTQNQLDRLRAILKS

SEQ ID NO: 3271 - protein, 70 aa, H. influenzae strain 86-028NP
MIKTFIFLTALIVLSGCGSVVKLIDPTEKYTAYAGVAYDLEMAQQWGLPILDLPLSFLLDTVLLPYAWAQ

SEQ ID NO: 3272 - protein, 156 aa, H. influenzae strain 86-028NP
MTSVIYPGTFDPITNGHLDIIERSAVIFPRVLVAVANSPSKKPLFSLEERVELVRQSVAHLSNVEVFGFSDLLANVIKQHNISAIIRGVRTTTDFEYELQLAALNRLLTKGVDSLFFPPAEKWAFVSSTIVREIYLHGGDVAELVPEPVFNALKAR

SEQ ID NO: 3273 - protein, 427 aa, H. influenzae strain 86-028NP
MWRFFYTSLLLICQPLILCFIGLLSVKSPRYRQRLAERYGFYGNVPCPPPQGIFIHAASVGEVIAAIPLVRQLQQDYPHLSITFTTFTPTGSERVKATFGDSVFHYYLPLDLPFSIHRFINFVQPKLCIVMETELWPNLIHQLFLRNIPFVIANARLSARSAHRYGKIKAHLQTMWSQISLIAAQDNISGKRYATLGYPKEKLNITGNIKYDLNTNDELLRKIDSLRTLWKQDRPIWIAASTHNGEDEIILKSHRALLAKYPNLLLLLVPRHPERFNVVADLLKKEKFQFIRRSTNELPNENTQVILGDSMGELMLMYGISDIAFVGGSLVKHGGHNPLEPLAFKMPVITGKHTFNFPEIFRMLVEVQGVLEVNSTADSLERAVEALLNSKEARERLGNAGYEVLMENRGALQRLLDLLKPYLERNV

SEQ ID NO: 3274 - protein, 254 aa, H. influenzae strain 86-028NP
MPTISVAMIVKNEAQDLANCLDTVKDWVDEIIILDSGSTDNTKEIALSYGAKFYENSDWQGFGKQRQLAQQYVTSDYVLWLDADERVTPKLQQAILSAVKNDRENTVYEIPRVSEVFGREIRHSGWYPDYVVRLYRTNYAQYNDSLVHEKVEFPAGTKVEKLTGDLEHFTYKSIHHYLVKSAGYAKAWADQRQAKGKKATLWQGISHALGCFVKMYLLKAGFLDGKQGFLLAVLSAHSTFVKYADLWERDQHKH

SEQ ID NO: 3275 - protein, 187 aa, H. influenzae strain 86-028NP
MQQITRCPWVGEQPIYIDYHDKEWGKPEFDSQKLFEKICLEGQQAGLSWITVLKKRESYRAAFHQFDPKKIAKMTALDIDACMQNSGLIRHRAKLEAIVKNAKAYLAMEKCGENFSNFIWSFVNHKPIVNDVPDLRSVPTKTEVSKALSQALKKRGFVFVGETTCYAFMQSMGLVDDHLNDCPCKTR

SEQ ID NO: 3276 - protein, 250 aa, H. influenzae strain 86-028NP
MENKYSDFMVYVDESGDHSLQSIDKNYPVFVLAFCIFYKDHYRNNIVPQIQKIKFDYFGHDMVILHEHEIRKEKGDFNIFTSREQREGFMERISSIIENTNFILAACVIDKRKTPQNETTHPYHFSLKHCLETLYEFVCEKHQEDKITFVAVESRGRNEDRELELEFLRICDGQNKFKKSLPFQVKIVPKQINSVGLQVADLVARPIGRHILDSNQPNRAFEILKKKFYCEGGRKILGENFDQKGLKHFP

SEQ ID NO: 3277 - protein, 268 aa, H. influenzae strain 86-028NP
MDLYAVWGNPITQSKSPLIQRQLAAQTHQTMEYIAKLGNLDSFEQQLLAFFEEGAKGCNITSPFKERAYQLADEYSQRAKLAEACNTLKKLDDGKLYADNTDGIGLVTDLERLNWLRPNQHVLILGAGGATKGVLLPLLQAQQNIVLANRTFSKTKELAERFQPYGNIQAVSMDSIPLQTYDVVINATSAGLSGGTAPVDVEILKLGLAFYDMQYAKGTDTPFIALCKSLGLTNVSDGFGMLVAQAAHSFHLWRGVMPDFVAVYEQLK

SEQ ID NO: 3278 - protein, 183 aa, H. influenzae strain 86-028NP
MNREQIAEALRQNQVVAYPTEAVFGLGCNPQSESAVKKLLDLKQRPVEKGLILVAPSLDFFRPFVDFEQINDEQLSHLQGKYERPTTWIVPAKSTTSHFLTGKFDSIAIRLCDHPSVKALCELTGFALTSTSANLTGEPPCRTADEVRLQFGADFPVLDEIVGDARNPSEIRDLRTNQLFRQG

SEQ ID NO: 3279 - protein, 178 aa, H. influenzae strain 86-028NP
MNQSLFHHSKQQEYCPQCGALLQIKQGKKGLFLGCSAYPECDYLRPLQRSEHKVLKTFDEICPKCGNLLQLKQGSFGMFIGCSHYPECDFVVREESESEEKITCPECKTGHLISRRGRQGKIFYGCDNFPKCKFSLPAKPYSVPCPTCHFPLSLLKSENGEKQIFQCANKTCRHIFEQ

SEQ ID NO: 3280 - protein, 638 aa, H. influenzae strain 86-028NP; identical to SEQ ID NO: 723

SEQ ID NO: 3281 - protein, 98 aa, H. influenzae strain 86-028NP
MNKISPLGSNWNEFEQQIFNEEEIRESNLRVALIKELITSRQQLGISQKQLETLSGVKQPMIARIEKGQTNPQLETLLKLLAPLGKTLSIVPLRVKNA

SEQ ID NO: 3282 - protein, 60 aa, H. influenzae strain 86-028NP
MYEILFYRDQNDIEPVKEYLLSLAQNESKDSRIKLNKIRDYVIQTTQQRLSELKERLKNE

SEQ ID NO: 3283 - protein, 992 aa, H. influenzae strain 86-028NP
MGLNMTNFRLNVLAYSVMLGLTAGVAYAAQPTNQPTNQPTNQPTNQNGNVSEQLEQINVSGSTENSDTKTPPKIAETVKTAKTLEREQANNIKDIVKYETGVTVVEAGRFGQSGFAIRGVDENRVAINIDGLRQAETLSSQGFKELFEGYGNFNNTRNGAEIETLKEVNITKGANSIKSGSGSLGGSVIYKTKDARDYLLNKDYYVSYKKGYATENNQSFNTLTLAGRYKKFDALVVTTSRNGHELENYDYKNANSLTQGKKREKADPYKIEQDSTLLKLSFNPTENHRFTLAADLYEHRSRGQDLSYTLKYQKTDPNLLEVDSRHTNDKTKRRNISFSYENFSQTPFWDTLKITYSDQRIKTRARTDDYCDAGVRYCEGTANPAGLKLTDGKITRRDGSELQFEKKDKNIDNNIYDFDKFIDTDDRVIEGKLGLRRSSGTWYDCSIFDCKDKTKMKIFETEHPYGYGTTGTWKKDFELEIKKLNDKNFARVKDANNKTYSILPSSPGYLERLWQERDLDTNTQQLNLDLTKDFKTWRVEHNLQYGSSYNTTMKRMVNRAGNDASDVQWWAEPTLGYSLLYDKPHTCKTAYGGWKANLCPRVDPKFSFLLPIKTKEKSVYLFDNVVITDYLSFDLGYRYDNIHYQPKYKHGVTPKLPDDIVKGLFIPLPSGKNNNDDPEVKKNVQQNIDYIAKQNKKYKAHSYSFVSTIDPTSFLRLQLKYSKGFRAPTSDEMYFTFKHPDFTILPNTNLKPEIAKTKEIAFTLHNDDWGFISTSLFKTNYKNFIDLIFKGEKDFKLVSGGSTLPFSLYQNINRDSAVVKGIEINSKVFLGKMAKFMDGFNLSYKYTYQKGRMDGNIPMNAIQPKTMVYGLGYDHPSQKFGFNFYTTHVASKNPEDTYDIYAKDKNQTNTSIKWRSKSYTILDLIGYVQPIKNLTIRAGVYNLTNRKYITWDSARSIRSFGTSNVIDQKTGQGINRFYAPGRNYKMSVQFEF

SEQ ID NO: 3284 - protein, 581 aa, H. influenzae strain 86-028NP
MMIDKRLINTVADSKKWIGVTVLWNWVALVGGIISAVVFSYILQAAYFHKLSLLSAVILGIVLIAALALRAFAGKKSVQASYFASTKVKHELRSLIYRKLASMPLNQVNQQSTSSIIQVASEGVEQLEIYFGRYLPQLFYSLLAPLTLFVFLIFFSFKTAVILLICVPLIPMSIIAVNKIAKKLLAKYWSIYVGLGSSFLDNLQGLITLKIYQDDGYKAKAMDKEAEHFRKITMKVLTMQLNSVSLMDLLAYGGAAIGILTALLQFQNAQLSVLGVILFILLSSEFFIPLRLLGSFFHVAMNGKAASDKIFTLLDTPVETQQSAVDFEAKNNVQVEIKDLHFSYSEEKSAITGLDLSILPNQLTVFVGKSGCGKSTLVSLLMGFNQAQQGEILFNGQNALNIDRTSFYQKVSLVSHSSYVFKGSLRENMTMAKIDATDEQIYACLEQVNLAQFVRENGGLDMQLLSRGANLSGGQIQRLALARALLHNAELYIFDEATSNIDVESEEIILQFIQQFKQQKTIVMISHRLANAVNADCINVLDQGKLIEQGTHESLMAKQGAYAEMFQQQKDLEQIREVANA

SEQ ID NO: 3285 - protein, 552 aa, H. influenzae strain 86-028NP
MRKNGFVVMGHLLKLVTPLAHIMAFTITMGTLGFLAAIFIMVFGAMGLVNLLNFDTHLSFSGILTALIVLAVARGVLRYLEQMSGHYIAFKLLALLRDKVFSSLRRLAFVKLQDKQAGQLVSLVTNDIELLEVFYAHTIAPIMIAFFTSAILLLVFAHLSGWFVVVALAAYLTVGVILPIITTKLAREDGRRYRELVGEMNDFFLDSVRGMKEIQLFGYAQQRLAEIQQRSQKIDTAFERIKDQEAKVRVYTEVAVSVFNIIMLFTGLILFSLDKIDFAAFLIGVILLMSSYGPVIALSNLSSNLLQTLASGERVLSLLAEEPELKDVESAVDLKDVSRIDVENLNFAYGEEQILSDVSLSVKKGEILGIHGRSGSGKSTLLKLLMRFYDPKSGSIKINGETLPNINTCSLRDNMAYITQQTYIFNETIEENIRLARRDATLEEIMEAAKKASIHDFILSLPQGYQTKMTELGGNLSDGEKQRIGIARAFLHNAPIILLDEPTSNLDSLNEAMILKSLLDAKAEKLIILVSHRQSTMAICDQVIGIENGRMS

SEQ ID NO: 3286 - protein, 343 aa, H. influenzae strain 86-028NP; identical to SEQ ID NO: 656

SEQ ID NO: 3287 - protein, 106 aa, H. influenzae strain 86-028NP
MRDLVRSGKVFLYGEFIGLLREDHRGFHFAYNPDYQGIPLSLSFPIEQSPFHSDTLFPYFASLVPEGWLKHKYALHQRIDESDMFRFLLNNGENMLGAVQIQEEKQ

SEQ ID NO: 3288 - protein, 102 aa, H. influenzae strain 86-028NP
MNNLSAQLENQIDELKKLQKSVITYEQSQRQQLYAGKITDLKAFGKMLNDKRKSLGIELSMLELQTGVSISTLNRLFQDPSQVRFTTVFLVAKTLGVSLCAI

SEQ ID NO: 3289 - protein, 333 aa, H. influenzae strain 86-028NP
MNRALAIEFSRVTEAAALAAYTWLGRGDKNAADDAAVKAMRYMLNLIHMDAEIVIGEGEIDEAPMLYIGEKVGSGLGELVSIAVDPIDGTRMTAMGQSNAISVLAAGGKNTFLKAPDMYMEKLVVGSNVKGIIDLNLPLEQNLRRIASKLGKSLSDLTVMVLAKPRHDAVIKQIHNLGAKVLAIPDGDVAGSVLCCLPDAEVDLLYGIGGAPEGVAAAAAIRALGGDMQARLIPRNEVKGDTEENKKIAANEIQRCAALGIKVNEVLKLEDLVRDDNLVFTATGITNGDLLKGISRKGNLASTETILIRGKSRTIRKIQSIHYLDDLYKILNI

SEQ ID NO: 3290 - protein, 72 aa, H. influenzae strain 86-028NP
MSLEILDQLEEKIKQAVETIQLLQLEVEELKEKNAESQRNIENLQTENEQLKNEHRNWQEHIRSLLGKFDNV

SEQ ID NO: 3291 - protein, 146 aa, H. influenzae strain 86-028NP
MHICILSGSTLGGAEYVAEHLNDVLETQGFSTALFHGPNLSDIENEKIWLIVTSTHGAGELPDNLKPLFDELANSQKDFSDVRFAVVGLGSSDYDTFCYAADKVEQTLQAKSAVKICETLKIDVLNVDDQESYAEEWLPSFIEGLK

SEQ ID NO: 3292 - protein, 144 aa, H. influenzae strain 86-028NP
MIALIQRVSQAKVNVKGETIGKIGKGLLVLLGVEKEDNREKADKLAEKVLNYRIFSDENDKMNLNVQQAQGELLIVSQFTLAADTQKGLRPSFSKGASPALANELYEYFIQKCAEKLPVSTGQFAADMQVSLTNDGPVTFWLNV

SEQ ID NO: 3293 - protein, 158 aa, H. influenzae strain 86-028NP
MIRIGHGFDVHAFGEDRPLIIGGVEVPYHTGFIAHSDGDVALHALTDAILGAAALGDIGKLFPDTDMQYKNADSRGLLREAFRQVQEKGYKIGNVDITIIAQAPKMRPHIDAMRAKIAEDILCDIEQVNVKATTTEKLGFTGRQEGIACEAVALLIRQ

SEQ ID NO: 3294 - protein, 225 aa, H. influenzae strain 86-028NP
MTRSIIAVLPAAGVGSRMQADKPKQYLTLLGKTLLEHTLDVMLSYPAVSKIILAVSKDDPYISTLSLDPKIQLVEGGTTRAESVLNGLNAIAEKNAWVLVHDAARPCLQHADIDKLLAIEDKQGAILAIPVTDTIKRADNQQCIVKTEDRSQLWQAMTPQFFPVDILRDALSTGIQQGANITDEASAIELAGFRPHLVAGRSDNLKVTRPEDLALAEFYLTRNKL

SEQ ID NO: 3295 - protein, 92 aa, H. influenzae strain 86-028NP
MRLLILILLSVLVLFQYNFWFGSNGFLDYRQNAEKIKENQAENEKLSQRNQRINAEIQGLTKGFEAIEERARMQHGLVKENEVFYHIVKESK

SEQ ID NO: 3296 - protein, 155 aa, H. influenzae strain 86-028NP
MSEKYVVTWDMFQMHARRLSERLLPASQWKGIIAVSRGGLFPAAVLARELGLRHIETVCIASYHDHNNQGELQVLHAAQVPNGGEGFIVVDDLVDTGNTARAIRQMYPNAKFVTVFAKPAGAELVDDYVIDIPQNTWIEQPWDLGLTFVPPLSRK

SEQ ID NO: 3297 - protein, 484 aa, H. influenzae strain 86-028NP
MSEITTLQPSLLWKWFDQICAIPHPSHYEDTLANFIVNWAKEKHFFVERDEVGNILIRKPATKGMENHTPVVLQAHLDMVPQANEGNPHDFTKDPIQPYIDGEWVKARGTTLGADNGIGLASTLAVLESNDLAHPPLEVLLTMTEETGMDGAKGLRHSWLQSEILINTDTEEIGEIYIGCAGGINANFEIPVQYETNTFERSAQITLKGLRGGHSGGDIHTGRANAIKVLARVLAKLSQNQPHFALSDIRGGSIRNAIPREAAAVLAFNGDVKTIESAVENLAVVLKEELAIAEPNFTLFVESAEKAPTVFTAQSTQTVINALNVLPNGVIRNSDVVKNVVESSLSVGVLKTEGNVVKSTILVRSLIESGKYYVTEMLSSLAILANAKVEFSAPYPGWQPVNDSTILDVTRKHYAEVLGEQPVVKVIHAGLECGLLKEHYPNIEMISVGPTIRNAHSPDEKVEIATVQTYWDLLTRVLADIPAK

SEQ ID NO: 3298 - protein, 295 aa, H. influenzae strain 86-028NP
MLTALNRYWDYLRIERQMSPHTITNYQHQLDATIKILAQQDIHSWTQVTPSVVRFILAESKKQGLKEKSLALRLSALRRFLSFLVQQGELKVNPATGISAPKQGWHLPKNMDGEQIQQLLANDSKEPIDIRDRAILELMYSSGLRLSELQGLDLNSINTRVREVRVIGKGNKERVVPFGRYASHAIQEWLKVRALFNPKDEALFVSQLGNRISHRAIQKRLETWGIRQGLNSHLNPHKLRHSFATHMLEASSDLRAVQELLGHSNLSTTQIYTHLNFQHLAEVYDQAHPRAKRKK

SEQ ID NO: 3299 - protein, 146 aa, H. influenzae strain 86-028NP
MKLFKAEQWNIEVLLPLFEAYRQAYGQAENPERTLAFLTNRMRFNESLFFIAVDENEKAIGFVQLFPRLSSLQLQRYWQITDIFVLEHAQQTEIYAALISKAKDFVHFTQSNRLVAELAQNQYSMLESEGFKLNPKERLFELSLSC

SEQ ID NO: 3300 - protein, 263 aa, H. influenzae strain 86-028NP
MARRPLVMGNWKLNGSKAFTKELIEGLKAELHDVTGCDVAIAPPVMYLGTAEAALSGCGCSCGGKSVIQLGAQNVDINVKGAFTGDISSEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 3301 - protein, 105 aa, H. influenzae strain 86-028NP
MSFKEITPQQAWEMMQQGAILVDIRDNMRFAYSHPKGAFHLTNQSFLQFEELADFDSPIIVSCYHGVSSRNVATFLVEQGYKNVFSMIGGFDGWCRAELPIDTTY

SEQ ID NO: 3302 - protein, 292 aa, H. influenzae strain 86-028NP
MFKGILVSLLASFLFGYMYYFSTLLKPLSGTDIFGYRMIFTFPFVLLSVTLFKQKAALIERLKRIQKRPHLALSYLLCGLLMGFQMWLFLWAPNNGSSLSVSFGYLLLPIVMVAAGRVFFKERISTFKFIAVIIATLGVISNIVLKGGLSWEAIVICLGYTAYFSIRKALKNTDLASFCLEMLSLMPVSIYFALQTDFATVQQTNPFIWGLLVLLGLISGTALIAYVIASNMLPMNLLGLLGYVETIMMLCVSFLIGEQIDSGSYPLFICLVIAMILVMVDGVYKQHAKGSL

SEQ ID NO: 3303 - protein, 292 aa, H. influenzae strain 86-028NP
MEFTDLQIFIHLSDTKNFAKTATQNHMSPSTLSRQIQRLEDELGKTLFIRDNRQVKLTEYGEKFLQFAKTEWQNWQQFKQQLKDKSDEFCGEIKLFCSVTASYSHLPHVLKEFRQRYPKVEIQLTTGDPALALELIQAQQVDLALAGKPNNLPSSVVFHKIDDISLSLIAPRVACLATQLLQEKPIDWQQMPFIFPVEGHARQRIEQWLREKQIKHPKIYATVAGHEGIVPMVGLGFGLAMLPDAVIDSSPMNNQISRLNLDKPIEPFELGICTQKRNLEQPLVRAFWAMLE

SEQ ID NO: 3304 - protein, 492 aa, H. influenzae strain 86-028NP
MANYFNTLNLRQKLDQLGRCRFMDREEFADEANFLKGKKIVIVGCGAQGLNQGLNMRDSGLDISYALRPEAIAEKRASFQRATENGFKVGTYEELIPTADLVVNLTPDKQHSKVVADVMPLMKKDSAFGYSHGFNIVEVGEEIRKDITVVMVAPKCPGTEVREEYKRGFGVPTLIAVHPENDPKGEGLAIAKAWAAATGGHKAGVLESSFVAEVKSDLMGEQTILCGMLQAGSIVCYDKLVADGKDPAYAGKLIQYGWETITEALKQGGITLMMDRLSNSAKLRAFELAEQIKESLGFLYYKHMDDIISGHFSATMMADWANGDKDLFAWREATGKTAFENAPKYDGKISEQEYFDNGVLMIAMVKAGVELAFDAMVASGIYEESAYYESLHELPLIANTIARKRLYEMNVVISDTAEYGNYLFSNVATPILAKEIIPNLQKGDLGEPTPAVEIDNITLRDVNDAIRNHPVELIGQELRGYMTDMKRIAVAG

SEQ ID NO: 3305 - protein, 426 aa, H. influenzae strain 86-028NP
MDNNIQRLIDSAKQSLNSPESHKYIDESFESCIKCTACTAVCPVSRNNPLYPGPKQSGPDGERLRLKSAELYDEALKYCTNCKRCEVACPSDVKIGDLIVRARNNHLAQSKKPLMNKLRDAILSNTDVMGKINTPLAPIVNTITSLKATKFMLEKTLKISKERTLPKYAFGTFRSWYMKNALQDQQKFERKVAYFHGCYVNYNNPQLGKEFLKVFNAMNIGVMLLEKEKCCGLPLMVNGFPNRARNIAQFNTDYIGKMVDENGIDVISEASSCSLNLRDEYHHILGIDNAKVRPHIHMVTPFLYQLFKEGKTLPLKPLKLRVAYHTACHVDKAGWAPYTLEVLKKIPGLEIIMLPSQCCGIAGTYGFKSENYEISQSIGKNLFDNINEGGFDYVISECQTCKWQIDMSSNVTCIHPLTLLCMSMDA

SEQ ID NO: 3306 - protein, 432 aa, H. influenzae strain 86-028NP
MNFDVAIIGGGLAGLTCGIALQQCGKRCVIINNGQAAIDFASGSLDLLSRMPSTTYGENRAVENLKENITALRNELPAHPYSLLGAEKVLAKAQDFERLANELNLDLIGSTEKNHWRVTGLGSLRGAWLSPNSVPTVQGNEPFPHKRIAVLGIEGYHDFQPQLLAANLVLNPQFEHCEVTSGFLNIPQLDELRKNAREFRSVNISQLLEHKLAFNDLVKEIIESAQGAEAVFLPACFGLENQEFMTALRDATKLALFELPTLPPSLLGMRQRIQLRHKFESLGGLMINGDSALNATFEGNKVRCINTRLLENEEITADNFVLASGSFFSKGLISEFDKIYEPVFESDIIGVEGFNQKDRFTWTVHRFAHPQPYQSAGVAINAQCQVQKCGQFLTNLYAVGNVIGGFNALELGCGSGVAVVTALAVADEILAK

SEQ ID NO: 3307 - protein, 563 aa, H. influenzae strain 86-028NP
MGLSPSIYKDVGDLSSLSTDVIIIGGGATGAGIVRDCALRGIDCILLERRDIATGATGRNHGLLHSGARYAVNDQESAEECIKENRILRKIARHCVDETEGLFITLPEDSLDYQKTFLESCAKSGIDAQAIDPDLAKIMEPSVNPDLVGAVVVPDGSIDPFRLTASNMMDATENGAKMFTYCEVKNLIREGGKVIGVNVYDHKNRRERQFFAPLVVNAGGIWGQGIAEYADLKIKMFPAKGALLVMGHRINKLVINRCRKPADADILVPGDTICVIGTTSSRIPYDQIDNMEVTPEEVDILFREGEKLAPSLRHTRVLRAYAGVRPLVASDDDPSGRNVSRGIVLLDHAERDGLDGFITITGGKLMTYRLMAEWATDLVCKKLNKTARCVTAEQPLPGSTESRQETNQKVISLPSTIRYSAVYRHGSRATRLLEKERLDRSMVCECEAVTAGEVRYAIDELDVNNLVDLRRRSRVGMGTCQAELCACRAAGLMNRFEVATPRQSTTQLSAFMEERWRGIEPIAWGEAIREAEFTSWMYGSVLGLNDVKPLDEQAQQGTDSNEF

SEQ ID NO: 3308 - protein, 480 aa, H. influenzae strain 86-028NP
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGTIVSIWNTAHNIGGMVPGAMVLLASAIFFSTHGIEAQAKDVWQQSLYFPGIAAMIFAIPVYFVMRDTPQSCGLPSIEKWRNDYPDDYNEKTYENDLTAKEIFVTYVLKNKLLWYIAIANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYENPYQLTDFVLMTLIGFLIYGPVMLIGLHALELAPKKAAGTAAGFTGLFGYLGGTVSASAVIGWAAQHYGWDGGFYVMIGGGVLAVLLLLIVMVEEGKHKAKLGDTYGTK

SEQ ID NO: 3309 - protein, 364 aa, H. influenzae strain 86-028NP
MKLKTLALSLLAAGVLAGCSSHSSNMANTQMKSDKIIIAHRGASGYLPEHTLESKALAFAQQADYLEQDLAMTKDGRLVVIHDHFLDGLTDVAKKFPHRHRKDGRYYVIDFTLKEIQSLEMTENFETKDGKQAQVYPNRFPLWKSHFRIHTFEDEIEFIQGLEKSTGKKVGIYPEIKAPWFHHQNGKDIAAETLKVLKKYGYDKKTDMVYLQTFDFNELKRIKTELLPQMGMDLKLVQLIAYTDWKETQEKDPKGYWVNYNYDWMFKPGAMAEVVKYADGVGPGWYMLVNKEESKPDNIVYTPLVKELAQYNVEVHPYTVRKDALPEFFTDVNQMYDALLNKSGATGVFTDFPDTGVEFLKGIK

SEQ ID NO: 3310 - protein, 264 aa, H. influenzae strain 86-028NP
MDKSLKANCIGEFLGTALLIFFGVGCVAALKVAGASFGLWEISIMWGMGVALAVYATAGLSGAHLNPAVTIALWKFACFDGKKVIPYIISQMLGAFFAAALVYALYRNVFIDYETVHNIVRGTQESLSLAGTFSTYPHPSLSIGGAFAVEFVITAILMALIMALTDDGNGVPRGPLAPLLIGILIAVIGGAMGPLTGFAMNPARDFGPKFFAYLAGWGELALTGGRKIPYFIVPMVAPVLGALAGAWLYKKAIGGNLPCNCGCE

SEQ ID NO: 3311 - protein, 503 aa, H. influenzae strain 86-028NP
MTDKKYIIALDQGTTSSRAVLLDHNANVVEIAQREFTQIYPRAGWVEHNPMEIWATQSSTLNEVVAKAGITSDEIAAIGITNQRETTIVWEKSTGTPVYNAIVWQCRRTADITDKLKADGHEEYIRNTTGLVVDPYFSGTKVKWILDNVEGAREKAERGELLFGTVDTWLVWKLTQGRVHVTDYTNASRTMLFNIHTKQWDDKMLEILNIPRSILPEVRNSSEIYGQTNIGGKGGVRIPVAGIAGDQQAALYGHLCVHAGQAKNTYGTGCFMLLHTGNKAITSKNGLLTTIACNAKGEPEYALEGSVFIAGASIQWLRDELKTVHDSFDSEYFAQKVTDSNGVYVVPAFTGLGAPYWDPYARGAIFGLSRGANCNHIVRATLQSIAYQTRDVLEAMQSDSGERLQYLRVDGGATNNNFLMQFQADILDVNVERPVVKEVTALGAAYLAGLATGFWKDLDELRDKARVERTFSPDSDNEKRERRYKGWKKAVKRSLEWAKEDEE

SEQ ID NO: 3312 - protein, 155 aa, H. influenzae strain 86-028NP
MSEKYVVTWDMFQMHARKLSERLLPASQWKGIIAVSRGGLFPAAVLARELGLRHIETVCIASYHDHNNQGELQVLHAAQVPNGGEGFIVVDDLVDTGNTARAIRQMYPNAKFVTVFAKPAGAELVDDYVIDIPQNTWIEQPWDLGLTFVPPLSRK

SEQ ID NO: 3313 - protein, 274 aa, H. influenzae strain 86-028NP
MKTTLKMTALTALSALVLAGCGAHQMKSEEQANMQLQQQAVLGLNWMQDSGEYKALAYQAYNAAKVAFDHAKVAKGKKKAVVADLDETMLDNSPYAGWQVQNNKPFDGKDWTRWVDARQSRAVPGAVEFNNYVNSHKGKVFYVTNRKDSSEKAGTIDDMKRLGFNGVEESAFYLKKDKSAKAARFAEIEKQGYEIVLYVGDNLDDFGNTVYGKLNADRRAFVDQNQGKFGKTFIMLPNANYGGWEGGLAEGYFKKDTQGQIKARLDAVQAWDGK

SEQ ID NO: 3314 - protein, 227 aa, H. influenzae strain 86-028NP
MKKNFSVGKLPFKGKSAVNFHRTFKPKLKPKTLSLDETKVVLFNKPFDVLTQFTDEQGRATLKDFISIPNVYAAGRLDRDSEGLLILTNNGELQHRLSDPKFKTEKTYWVQVEGIPEETDLAQLRKGVELKDGMTKQAQVRLISEPNLWERNPPIRERKNIPTSWLEIKISEGRNRQVRRMTAHIGFPTLRLVRVSMGSLSIDGLANGSFRLLSLDEIKVLFQTVKL

SEQ ID NO: 3315 - protein, 1294 aa, H. influenzae strain 86-028NP
MTEQLQPSETSPKLPEKPNKKHWVRKAVCIGSAVIFIPVLGVAGVLSFDAGQRGLIQLVDKMLDSFSVEQIEGGLQNGLVLKNVRYQTAGIETHIAQARLQLDFGCLLSREVCLRDFTLNKPTIAINTALLPPSAPDNSKSGSMKRISLPISINAENLVVQDLSVNIDQTNITLGNFKSAVSLNNEKGLTIAPTEINDISVIAKKLPEGKPELKAKQPNKPVDWAAIEQSLTPAFLGNVSDIILPFDLHIPEISGKNWQYQAVNEKDETLQSVEMSSLIAQADTVDNQLQLQKLAVESSLGNLSSQGKLQLDGDMPLDLTLKSHLEPLKSAGKEILPESDVDLTLSGSLKKSTALSVKTKGVLDAELNGNVQLAQDKMPLNLTLNVAKGQYTFVNTMTPLKINDVTLKLTGDLLNYHAEFKGNVAGMNYIPASQVDFNADGKLYEITVNKLGIASLDGKSEFVGNANWKNGANWDIQADLEKMNIGFFVPVMPAILSGKLHSRGFADSQGWQVEVPTADLNGILSAKPISLKGSATLNQNVLLTVPDLQIRYGENYLKASGVLDDHSDFVLDIDAPNLRGLWSDLKGRVAISGQITTPNLDLDLTSSNLHLQGFQLAKASIKGHINNTPLSSGKLNIKSEQLHYGENIKLHLLDLDLSGDEQNHKLILKSQGEPVAANLQINGHFDRTLEQWKGTLSQAKFETPIGDVKSNQAIAVSYDNKQTQANIAAHCWQNTDIELCFPQAFNAGKQGNIPFQFKRVNLDLMNKLIEQDSLKGNLQAQGNVAWFTDKPFQFSTKVDGNHLAFSQKLDYRTFKLDIPKLTLNADIQNNNLVLKTDINLHNQGRIVGDIRLNDFVKTRQLGGTLAIERLNLSIANQLLTSGESVNGKVVSKLSFGGNLEKPLLNGDFNIRNIRTKLKSMPVNITDGDIALRFNGNRSTLQGKIETVDSHLNLTGRANWANIEHWTTELNAQANNFNVDIPSMAKLRFSPDITIKANPKELNLSGTVDIPWARIKIDSLPDTAEPVSEDEVILNGPHKSKEELIKREFAAKTKSGMDIRSDLRINIGKDVSLDAYGLKTNLDGLLSVKQDKGNLGLFGQINLTKGRYASFGQDLLIRKGLISFSGQAAQPTLNIEAIRNPETMEDSKITAGVRVIGIADSPEVTIFSEPSKPQDQALSYLLTGRSLESSGEVGSTGSVGAALIGLGISKSGKLVGSIGEVFGIQDLNLGTSGVGDKSKVTVSGNITNRLQIKYGVGLFDGLAEVTLRYRLMPQLYFQSVSSTNQVFDLLYKFEF

SEQ ID NO: 3316 - protein, 578 aa, H. influenzae strain 86-028NP
MKKKSLKLTALFLALSCFPAFAEQTVDIEVQGIRGFRAVRNTDLNVNLINKEEMDGSERYQHLVTKAVDRGLRVFGYYESSVRFERKQRQGKRDLLIAHVTPGEPTKIAGTDVQIEGEAAQDENFNALRKNLPKDGVLVEHQTYDDYKTAISRLALNRGYFDGNFKISRLEISPETHQAWWRMLFDSGVRYHYGNITFSHSQIRDDYLNNILNIKSGDPYLMNNLSDLTSDFSSSNWFSSVLVQPNINHKSKTVDIEIILYPRKKNAMELGVGFATDGGVHGQIGWTKPWINSRGHSLRSNLYLSAPKQTLEATYRMPLLKNPLNYYYDFAVGWEGEKENDTNTRVLTLSALRYWNNAHGWQYFGGLRTRYDSFTQADITDKTLLLYPTVGFTRTRLRGGSFATWGDVQKITFDLSKRIWLSESSFIKVQASSAWVRTYAENHRIVARAEIGYLHTKGIEKIPPTLRFFAGGDRSVRGYGYKKIAPKNKNGKLVGGSRLLTASLEYQYQVYPNWWAATFADSGLAADNYTAKELRYGAGVGVRWASPVGAIKFDIATPIRDKDNSKNIQFYIGLGTEI

SEQ ID NO: 3317 - protein, 190 aa, H. influenzae strain 86-028NP
MKVEKNVVVSISYQVRTQDGVLVDEAPANQPLEYLQGHNNLVVGLEKALEGKEVGDKFEVRVQPEEGYGAYSENMVQRVPKDVFQGVDELEVGMRFLADTDIGPVPVVITEIDGDEVVVDGNHMLAGQELHFTVEVVAAREATLEEIAHGHVHGAHSHDDDEEGHGCGCGGHHHEHNHEHNHGSCGCGGH

SEQ ID NO: 3318 - protein, 140 aa, H. influenzae strain 86-028NP
MSKLAELQAETREIIEDLLNDGSDPNALYIIEHHIAHHDFDLLEKIAVDAFKAGYEVSEAEEFKDDDGKPIFCFDIISEVELKAEIIDAQQKQILPLLEKHKGIYDGWGTYFEDPNADDDEYGDDGEFFDDEDEEEPRVH

SEQ ID NO: 3319 - protein, 339 aa, H. influenzae strain 86-028NP
MLEQLPYLALKTPPKTTALLKAECADFIVKEHLGYEMSGDGEFVALYVRKTDCNTLFVGEKLAKFAGVSERNMGYAGLKDRRAVTEQWFCLQMPGMETPDFSQFELDGVEILTVTRHNRKIRTGSLEGNYFDILLRGAEESDELKVRLDFVANFGFPNYFTEQRFGREGHNLTQALRWAQGEIKVKDRKKRSFYLSAARSEIFNLVVAARIAKGATNQVLPNDIVQLAGSHSWFKADEKEDLTVLQVRLENQDILLTAPLIGEDILAASDIENEIVNQHSAFDSLMKQERMKAVRRPLLMKAKGFSWAFEPEGLRLKFYLPAGSYATALVRELVNYTEE

SEQ ID NO: 3320 - protein, 249 aa, H. influenzae strain 86-028NP
MRILVSNDDGFHAEGIQVLAMELRKIAEVIIVAPDRNRSAASSSLTLVEPLRPRHLDNGDYCVNGTPADCVHLALNGFLSGQVDLVVSGINAGCNMGDDTIYSGTLAAALEGRHLGLPAIAVSLDGRQHYETAARVVCDLIPKLHHQLLNPREIININVPDLLFEELKGYKVCRLGYRASSAEVIKQKDPRDETIYWIGPSALPEDESEGTDFYAVKNGYVSITPIQADLTAYHSLLSLQNWLEQEFTK

SEQ ID NO: 3321 - protein, 192 aa, H. influenzae strain 86-028NP
MKIFGTMYDKTMEWSKHRFAVFWLSFVSFIEAIFFPIPPDVMLIPMSMSKPKSAVKFAFYTAIASVIGGIIGYAIGFYATGWVENIVQQWGYAAHWAKAVSWFEQWGVLVVFVAGFSPIPYKVFTLCAGVMQMAFFPFVITAFVSRLARFLLVAKLAAWGGEKFAAKLRKSIEIIGWSVVVLAIIAYFILKN

SEQ ID NO: 3322 - protein, 61 aa, H. influenzae strain 86-028NP
MNKLSLVLVAGFLLVGCASEPVKDPDALPNGIMQPVEGTGAVAGGSFMPEIQKNTIPTQMK

SEQ ID NO: 3323 - protein, 405 aa, H. influenzae strain 86-028NP; identical to SEQ ID NO: 741

SEQ ID NO: 3324 - protein, 472 aa, H. influenzae strain 86-028NP
MENFKHLPEPFRIRVIEPVKRTTREYREQAMLKSGMNPFLLDSEDIFIDLLTDSGTGAVTQDMQAAMLRGDEAYSGSRSYYALAKAVKDIFGYEYTIPTHQGRGAEQIYIPVLIAKREREKGLDRSKMVVFSNYFFDTTQGHSQINGATVRNVYIKEAFDTTAKHPFKGNFDLEKLEKGIQEAGAHNVPYIVCTITCNSAGGQPVSIANLKGMYEIARKYDIPVIMDSARFAENAYFVQQREEAYKDWTIEQITYESYRYADGLAMSAKKDAMVPMGGILAFKDKSMEEVYHECRTLCVVQEGFPTYGGLEGGAMERLAVGLHDGMRQEWLAYRIAQIEYLVAGLEKIGVPCQQPGGHAAFVDAGKLLPHIPADQFPAQALSCELYKVAGIRAVEIGSFLLGRDPKTGKQLPCPAELLRLTIPRATYTQTHMDFIIEAFQKVKENAENIKGLTFTYEPKVLRHFTARLKEVE

SEQ ID NO: 3325 - protein, 410 aa, H. influenzae strain 86-028NP
MKKQPSIFGGACIIASVCVGAGMLGLPTSGAGAWTIWSVLVICLTMIVMTLSGWLLLEAYSTYDLRASFSTVTKDMLGSTVNSINNLAVYFVGGILLYAYTTASGGILENLIKPWIDFGSSTLAICSTVFVLVFSFFVWHSTRIVDRISVLLIVCMGFTFIFSTYGLATNISLDTLLDIGGKETNYAKYAVGMFPVALTSFGYHHSVCTMRAYYGEEKKAKYAILGGTAIALTLYLLWIFSIFGNLPRDQFAPVIASDGNLDILLNTLGGVIESNTVKQMINAFSIAAILSSFIGVGLGVFDYLADFFKFDNCKIGRTKSWAVTFLPPLIMSILFPLGFLKAIGYAGAVATIWTSIIPALLAYKSRKINTAATFRVCGGNGLIIFIALFGVFVAIFHFLAMFGCLPFFKF

SEQ ID NO: 3326 - protein, 861 aa, H. influenzae strain 86-028NP
MISEENFQQHTPMMQQYLKLKAENPDILLFYRMGDFYELFYDDAKKAAALLDISLTKRGQSAGQPIPMAGMPYHAVEGYLAKLVQLGESVAICEQIGDPSTSKGPVERQIVRIVTPGTVSDEALLPERQDNLIAAVYQEKEKFGLATLDMTSGRFQLCEPADKETLRAELQRIVPVELLYCEEFNEMAAIEHCKGLRRRPIWEFELSTAITLLNRQFGTKDLRAFGVEKSPLGLSAAGCLLQYAKETQRTALPHIQSISLIQNQDCIQLDAATRRNLELTQNLSGGTENTLASVLDKCVTPMGSRLLKRWIHQPIRDVEKLKQRQQAIAEILNFDLVDELQPYLQLVGDMERILARVALRSARPRDLTRLRTALEQIPALRTIVQQKTSPFLTALFSQIADFSEQWDLLQRALIETPPLLIRDGGVIAEGYHAELDEWRMLSDGATQYLENLEKRERESTGIDTLKIGFNAVHGYYIQISQGQAHKAPIHYVRRQTLKNAERYIIPELKEYEDKVLKSKGAALALEKQLYDELFDLLLPHLGSLQLASLALSELDVLVNLAECADTLNYVMPTFCDEVSVKIENGRHPVVEQVLKDPFIANPVELNHNRHLLIITGPNMGGKSTYMRQTALITLLAYIGSFVPADSARIGPIDRIFTRIGASDDLASGRSTFMVEMTEMANILHQATEQSLVLIDEIGRGTSTYDGLSLAWACAEWLAKKIRSLTLFATHYFELTALPEQLEGIANIHLDALEHNNSIAFMHAVQDGAASKSYGLAVAALAGVPQSVIKLAKQKLTQLEKNSSYSAEQQIQALREANHNQGELLFEQETDALREAIEKLDPDDLSPKQALAYLYQLKKMVG

SEQ ID NO: 3327 - protein, 461 aa, H. influenzae strain 86-028NP
MTALFQQLPSVDKILKTSQGLQLITEFGHTAVVATCRELLTQARQFIKKNNQLPEYFSNFDRTFVEIHSRLQKQNQVQIKAVHNLTGTVLHTNLGRALWSEAAQQAALSVMQKNVSLEYDLDKGKRSHRDNYISELLCKLTGAEAACIVNNNAAAVLLMLATFAQGKEVIISRGELIEIGGAFRIPDIMEQAGCYLVEVGTTNRTHLKDYRNAITENTAFLMKVHSSNYQICGFTSSVSEEELAELGREMNVPVVTDLGSGALIDLSQYGLPKESTVQEKVAQGVGLVSFSGDKLLGGVQAGIIVGKKEWIEQLQAHPLKRALRCDKVILAGLEATLRLYLNPEKLTEKLPTLYLLTQPLKQLKINAMRLKERLESRLNSQFDIQIEASQAQIGSGSQPMERIPSVAVTIAEKTNVKLSALSARFKQLSQPIIGRMENGKIWLDLRSLAAIETLLNTLDEL

SEQ ID NO: 3328 - protein, 619 aa, H. influenzae strain 86-028NP
MIIVTSGHVDHGKTALLKALTGTSTAHLPEEKKRGMTIDLGYAYLPLENKVLGFIDVPGHEKFLSNMLAGLGGVHYAMLIVAADEGVATQTKEHLAILRQLQFHEIIVIITKADRANSAQIESLIQEIKQNYSFLRGANYFVTSAETGQGINELRHYLANLPELSDTQKPFRYAIDRVFNVKGAGTVVTGTAFSGTVKVNDEIYLSTGQKVRIKAIHAQNTSSEQGIAGQRLALNLNADLDRTSMKRGDWLLQNEPLPPTDRISVQILAEVPLNENQPVHIYHGASRTTGKLTLLQGKNAAKNDRTLAEIILDSPLFLAFGDKLILRSGDTKTLIAGARVLEINSPKRHKRTEVRLNFLANLALAENASQRIALTLKHNATTARQLMWTEQLTSLQLDKALVERDAVRYQDWCFNTNYIQEKTQQILTALNTYHEQHNDQLGVSKARLYRMTALNQPENLINHFIDEMLKEGRLQQTRGWLHLPEHKIQFSQEEQKYWSSVFDEFEKAQGQAIWVRDMANALAIDESIMRNFMYKAGKLGYLTPIVKDRFFLTETIYAYARLIKQIAEEQGKVSVNEVRDKLNFGRKLTVQLMEYFDRMGFLRRKGNDHILRDKNVFDL

SEQ ID NO: 3329 - protein, 284 aa, H. influenzae strain 86-028NP
MKKTLVAALISSVILLTGCQDKDTEAKIKQLNQTVAQLSAENTKLKEQIEKTVPAIIVENDEIFNQSEIIKHPKSKEDYQPEETKIEYSISTIKTNIDWLNDLLWKKLTENEETKNISREQFVARYQTAFEEDKKEAKETPSFGISHSIWTNFIGQKEKLATFAISFYDYEGGAHGIEGNRYFTIDLTTRHILTLNDLFNEKDLPKVKTLLWEQYNNSNKEYEPIIEADSFNLSNNIYLDSKGVHFIYDVYEIAPYAAGEQDLMLHFGQLEELFKPEFRQGNDI

SEQ ID NO: 3330 - protein, 98 aa, H. influenzae strain 86-028NP
MALTNSSISFRTVEQTKSEAYQVIEQYGLTPSQVFNMFLAQIAKTRSIPIDLNYLRPNKETLAAIDELDSGNAESFFIEASENYSAEEFTKRILNGGQ

SEQ ID NO: 3331 - protein, 102 aa, H. influenzae strain 86-028NP
MSEEKPLKVSYSKQFVRDLTDLAKRSPNVLIGSKYITAIYCLLNRLPLPENYQDHALVGEWKGYRDCHIQGNLVLIYQYVIHDEFDELKFSRLNTHSQTALK

SEQ ID NO: 3332 - protein, 1038 aa, H. influenzae strain 86-028NP
NQPTNQPTNQPTNQPTNQPTNQPTNQNSNVSEQLEQINVSGSTETINVKEKKVGETQISAKKLAKQQASDSRDLVRYETGITVVETGRTGASGYAVRGVDENRVGIMVDGLRQAETLSSQGFKELFEGYGNFNNTRNSIEIENVKTATITKGADSLKSGSGALGGSVIFETKDARDYLIDKDYYLSYKRGYQTMNNQNLKTLTLAGRSKKFDILVVDTKRDGHEIENYDYKIYPNKQADLSAVGPTREKADPYQITRQSTLIKLGFQPNENHRLSVALDDSTLETKGMDLSYIFNQCKNTKCEEKYGERVINDQSKRKNIQFSYENFSQTPFWDHIKLSYSSQKITNKARSDEYCHQSTCAGVRNPQGLHLVEEGGIYKIKDKDNQEFTGKYNYGLELQNKKGEDVSNDVDTEGGSLDSVLINCEKLNCNKKFQVFVGKDENGNDKYNYEDRNITIKELNGKKYGEISLKSAEGNYGLTQYESAKFLFPKSHGYSTDFVNDRDLNTHTQQIKLDLDKEFHLWHTQHQLKYGGLYEKTLKSMVNHQYYTVANVQWWAGNFFCNKPVDGTYPVEHTPAPDHSAYRCSLMNSNKGKDTYLIPVTTKNNVLYFGDNVQLTSWLGLDLNYRYDHVKYLPSYDKNIPVPNGLITGLFKKFSSKEYVYGSKYSIPPGYENCTYDTPCYKKNFEDNLALLLRKTDYKHHSYNLGLNLDPTNWLRVQLKYANGFRAPTSDEIYMTFKHPQFSIQPNTDLKAETSKTKEVAFTFYKNSSYITLNAFQNDYRNFIDLVEVGERPIEEGSAIKYPFHQNQNRDRARVRGIEIASRLEMGDLFEKLQGFHLGYKFTYQKGRIKDNGLHPKYKEFLELNKDEHPEYEAIARKPQPMNALQPTTSVYNIGYDAPSQKWGVDMYITNVAAKKAKDSFNSQWTSMVARKEKQYTDNATDIPATKANGKDVKDSRGLWRNNRYTVIDTIAYWKPIKNLTFTAGVYNLTNKKYLTWDSARSVRHLGTINRVKTETGEGLNRFYAPGRNYRMSVQFEF

SEQ ID NO: 3333 - protein, 432 aa, H. influenzae strain 86-028NP
MSLNIETTQGLERRVAITVPTEIVSKAVREEFKRAAKNVRVDGFRKGHVPAHIIEQRFGASIRQDVLNDLLPRHFFDAVIAEKINIAGRPTFAIETFEEGKDLVFTATFEVYPEVKLQGLENIKVEKPTVEITEADIDKMIDVLRKQQATWAESQDVVKADDRVTIDFVGSVDGEEFEGGKATDFVLFMGQGRMIPGFEEGIVGHKAGEQFDIDVTFPAEYHAENLKGKAAKFAITLKKIENMVLPELTDEFVAKFGPNTKSVADLRAEIRKNMERELKNALVSRVKQQVINGLIEQNPIDVPASAVEEEINVLRNQAAQRFGGNAQQTAQLPRELFEAEATRRVQVGLLFSEVIKSNELKADEERAKAMIADIASAYEQPAEVVEYYSKNEELMNNIRNVVLEEQAVDAVLAKAQVTEKVSSFDEIMNPQA

SEQ ID NO: 3334 - protein, 193 aa, H. influenzae strain 86-028NP
MSVIPMVVEQTSRGERSYDIYSRLLKERVIFLSGEVEDRMANLIVAQLLFLESEDPTKDINIYINSPGGSVTAGMAIYDTMQFIKPDIRTLCIGQACSMGAFLLAGGTAGKRAALPNARVMIHQPLGGFRGQASDIQIHAQEILKIKHTLNDRLAFHTGQGIERIEKDTDRDNFMSAEEAQAYGLVDEVLVKR

SEQ ID NO: 3335 - protein, 411 aa, H. influenzae strain 86-028NP
MTDKDKDLHCSFCGKEKGEVDRLIAGTDGYICNECIELCHSMLEESHDKNLEESAVENEEKLPTPHEIRAHLDDYVIGQDYAKKVLSVAVYNHYKRLRTNYESNDVELGKSNILLIGPTGSGKTLLAQTLARRLNVPFAMADATTLTEAGYVGEDVENVLQKLLQNCEYDTEKAEKGIIYIDEIDKISRKSEGASITRDVSGEGVQQALLKLIEGTIASIPPQGGRKHPQQEMVKLDTSKILFICGGAFAGLDKIIDKRTQTSTSIGFNAKVEKDEKQQSLSELFRQVEPDDLMKFGLIPEFIGRLPMIAPLSELDEDALIQILTKPKNALIKQYQALFGLEKVELDFTPEALKAMAKKALERKTGARGLRSIVEAVLLDTMYDLPSLENLQKVIVDESTIVDNLAPKLEY

SEQ ID NO: 3336 - protein, 138 aa, H. influenzae strain 86-028NP
MATEIVDKKKNTQEVIVEGKSKGLNTFLWVLVVIFFAAAAIGNIYFQQIYSLPIRVIGMAIALVIAFILAAITNQGTKARAFFNDSRTEARKVVWPTRAEARQTTLIVIGVTMIASLFFWAVDSIIVTVINFLTDLRF

SEQ ID NO: 3337 - protein, 185 aa, H. influenzae strain 86-028NP
MTEETTVSKKRWYVLQAFSGFESRVALTLREYIKQQQMEDQFGEVLVPTEEVVENVAGKRRKSERKFFPGYVLVEMEMNDETWHLVKSVPRVMGFIGGTPDKPAPISKREADTILNRLEQNTDKPRHRNEYHPGEEVRVTEGPFADFNGTVEEVDYEKGRLKVSVSIFGRATPVELEFGQVEKIH

SEQ ID NO: 3338 - protein, 250 aa, H. influenzae strain 86-028NP
MKTKVILTALLSAIALTGCANHNATKQASERNDSLEDFNRTMWKFNYNVIDRYVLEPAAKGWNNYVPKPISSGLAGIANNLDEPVSFINRLIEGEPKKAFVHFNRFWINTVFGLGGFIDFASASKELRIDNQRGFGETLGSYGVDAGTYIVLPIYNATTPRQLTGAVVDAAYMYPFWQWVGGPWALVKYGVQAVDARAKNLNNAELLRQAQDPYITFREAYYQNLQFKVNDGKLVESKESLPDDILKEID

SEQ ID NO: 3339 - protein, 130 aa, H. influenzae strain 86-028NP
MMTQIIHTEKAPAAIGPYVQAVDLGNLVLTSGQIPVNPATGEVPADIVAQARQSLENVKAIIEKAGLTAADIVKTTVFVKDLNDFAAVNAEYERFFKENNHPNFPARSCVEVARLPKDVGLEIEAIAVRK

SEQ ID NO: 3340 - protein, 283 aa, H. influenzae strain 86-028NP; identical to SEQ ID NO: 751

SEQ ID NO: 3341 - protein, 93 aa, H. influenzae strain 86-028NP
VRYDMALFFKRKKNMSEISVTQTLNTLGLRCPEPVMLVRKNIRHLNDGEILLIIADDPATTRDIPSFCQFMDHTLLQSEVEKPPFKYWVKRGK

SEQ ID NO: 3342 - protein, 206 aa, H. influenzae strain 86-028NP
MAEYLVPKSAVVFEEEIKKSRFITYLQHTEGLEDARAFWAKIKQEHPNARHHCWAAVAGKPTDSLQLGFSDDGEPAGTAGKPMLSALQGSQLGEISAVVVRYYGGILLGTGGLVRAYGNGVQQALKLIESEIKVERTPFKLDCDYGQLRLVQQLCEKYQVEILSQGFQANIHLILGISEKTIEAFSSELTEKSSGRLVIQLLEIGE

SEQ ID NO: 3343 - protein, 487 aa, H. influenzae strain 86-028NP
VRILSIIRIIGILVMCFSGTMLVPAFVALIYGDGGGKAFMQAFMLSLTAGTLLWWPCHHHKQELRSRDGFLIVVAFWLVLGSLATLPLLLFDSPHLTIASAVFEAFSGLTTTGATVMTGLDNLPKSILFYRQFLQWLGGMGIIVLAVAIIPLLGIGGTQLYRAESSGPLKDQKSLPKISEVAKALWIIYASLTVLCAIAYWLSGMNLFDAIGHSFSTISNGGFSTHDASIGYFNQASIYWVTTIFMLIGGVNFSLHISAFLALGKRNIWRNYWKDPEFRFFLTMQIIFIGIVSLSLYGYGLVSDINEAVTKGALQLTSMSMTAGYTIFDIDNLPPFIGLLLVISAVIGGCGGSTTGGLKAIRTLILWKQIDRELHSLIHPNLVQPIRIGKNRLAPRMIESIWAFFIIFILVYWGCVFAVILCGMNTFDAMGAVFATLTNAGPGLGFIHESFIGVPESAKLVFSFAMICGRLEMFSLIVLFIPSYWKK

SEQ ID NO: 3344 - protein, 139 aa, H. influenzae strain 86-028NP
MEESLELEKLPRIITDVLKIVLCTALIALAIVLIIALVKITYTLSMMVLNTSSVVPYDVAEQAVMFFLYFGFIGLIVQYFKSGYHFPLRYFIYAGITAMLRLIIVNHESSVDTILFAGAILIMVIALCLVLYSNKLKNI

SEQ ID NO: 3345 - protein, 428 aa, H. influenzae strain 86-028NP
MFRVLFLMLTLLVGLVAGPYISGQQGYVRIETANRIIEMSITTLVIFFIISLAIIYAFEWGITRFFRLSRSSYQWFSNRKRVKAQKQTLEGLVKMNEGDYAKAEKLIGKNAKHSAEPVLNLIKAAEAAQQRGDEFSANRYLIEATELAGSDNLLVEIARTRILLQQNKLPAARSSVDSLLEMARRNKEVLKLAVEIYLRSKAYQALDKILDNVANSGLFNDEEFKDLRSKTENGLLDEKMNEEGIDGLLTWWNQQPRHRRNNIELKISLIQRLIDCNDHESATELTFEILKKLGDNTAISLPLCTQITRLQPEDNSKLLKLIEKRAKRVDEKQKCCINRALGYLYVRNNEFIKAADVFKNVIACPEQLEQNDLMMASYVFEQAGDKALAEQVRQESLKSVMAIQDVIPESAEEKTEENSTALLESKSE

SEQ ID NO: 3346 - protein, 403 aa, H. influenzae strain 86-028NP
MAKEQPNDLTEQLTDTPKTAVEQAETMQSVPQTIVKKTGTALSLLAILVALGIGGAGYYFGQQQIAEIQQKLTALENQTGANLSSNNTNNNKRLTQLEQSLKTAQENIAQLEQLIVSKTGEITSLQTQMKQVSQLAIAQQPSDWLFSEADFLLNNALRKLVLDNDVDTAVSLLKLADETLVKVNNSQANEIRSAINQDLKQLLSLSSVDQNAIMQKLSQLANTVDELQALNVNFDETSKNNDKLSNNITDWQQNIEKSATSFLNHFIRISPKQNSNKKELLAPNQDIYLRENIRLRLQLAIMAVPRQQNELYKQSLEAVSSWVRSYFDTNAEVTQNFLKLVDGLTDTSIYVDVPEQLKSLTLLDKYLNRTALDLQKVEIEADKAIDTMPKVEAVKPTQSESQQ

SEQ ID NO: 3347 - protein, 843 aa, H. influenzae strain 86-028NP
VECNLAQAKQWVSALDQRRFERALQGSGDAFQHVLAIAPLLLHLNHPQLPGYVIHAPSGIANFLASDYQKKWLTNEYSIHYADHKPSTLKSAVNFHEVLPPILGVYVMGSFGSISQTSSSDLDTWICVRDGLSPDEYTLLTQKAKRISEWAMQFNVEINFYLMDQQRFRNEHYADPLTIENSGSAQYMLLLDEFYRSAVRLAGKPLLWLHLWVENEKDYEKQVARLITEGEIDPNDWVDFGGLGQFSANEYFGASLWHLYKGIDSPYKSVLKILLLEAYSKEYPNTCLIARTFKRDLLSGNTNPDHHFDPYIAILAKVTQYLTALSEFKRLDFVHRCFYVKATEDFARYQANNWRIRYMEILAQEWGWSAETVKHLNKRPFWKIKAVKENHDNIMKFLMLSYRNLVEFARKHHIHSSVVPQDINILSRKLYTAFEELPGKVSLLNTQISHNLSEAHLTFVEVRGNKHFKDSWYLINQPIHHIMFSKERVIEYGESLNKLVSWAYFNHLLTEKTELSIFSKNVTLSTLQRFVTNLRQSFPSTIAKQPKNSDLLNQCEIRSLFIAINLTTDPTSKVEEVLTGISSRDLFSFGSLEQSLVGSIDFTYRNVWNEIRTLHFEGQNAILLALKVLSNKIYRGVNRPDSIQVYCYSERYRQDLRQLVMGLVNRCVSIQVGDIQQPCQTSRLRVAGKNWQLFFEDRGISLQEIGNESVCNDAESAVDFDEVLQTPIEDGETNQESRRYPPEMDAFASEGFLQFFFEDNSDHSFNVYILDESNHLEIYRHCDGEKDEKVREINQLYQNAKQEGDKNPYNIVQHNFNYPQFYQLQNGKNGISIVPFKFRQMNK

SEQ ID NO: 3348 - protein, 335 aa, H. influenzae strain 86-028NP
MITSQTPITVLGAGSYGTALAITFSRNGSPTHLWGHNPVHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKNAQDVAISLLGRACKGE

SEQ ID NO: 3349 - protein, 267 aa, H. influenzae strain 86-028NP
MTLDVWQHIRQEAKELAENEPMLASFFHSTILKHQNLGGALSYLLANKLANPIMPAISLREIIEEAYQSNPSIIDCAACDIQAVRHRDPAVELWSTPLLYLKGFHAIQSYRITHYLWNQNRKSLALYLQNQISVAFDVDIHPAAKIGHGIMFDHATGIVVGETSVIENDVSILQGVTLGGTGKESGDRHPKVREGVMIGAGAKILGNIEVGKYAKIGANSVVLNPVPEYATAAGVPARIVSQDKAAKPAFDMNQYFIGIDDGMNLNI

SEQ ID NO: 3350 - protein, 271 aa, H. influenzae strain 86-028NP
MINKDTQLCMSLSGRPSNFGTTFHNYLYDKLGLNFIYKAFTTQDIEHAIKGVRALGIRGCAVSMPFKETCMPFLDEIHPSAQAIESVNTIVNDNGFLRAYNTDYIAIVKLIEKYHLNKNAKVIVHGSGGMAKAVVAAFKNSGFEKLKIYARNVKTGQYLAALYGYAYINSLENQQADILVNVTPIGMKGGKEEMDLAFPKAFIDNASVAFDVVAMPVETPFIRYAQARGKQTISGAEVIVLQAVEQFELYTHQRPSDELIAEAAAFARTKF

SEQ ID NO: 3351 - protein, 461 aa, H. influenzae strain 86-028NP
MGEMASLRSHKNGIIFILDIVLFFVLLNVLPFEPKANSGLALLAFIAVLWLSEALHVTITALLVPLLAVALGLVSTKQALVGFADPTIFLFFGGFSLATALHIQKLDKLIANKIMALARGNLFIAVIYLFLITAFLSMWMSNTATAAMMLPLAMGILSQLDREKDHNTYVFVLLGIAYSASIGGMGTLVGSPPNAIVASNLNLTFSDWLWYGLPIMIILLPLMIGILYIIFKPKLHLNFEQTFENIEMNPMRILTFIIFSVIALTWIFSGKINPFISGLLGLQKNIASFDSIVALLAAIVICSTGVASWKQIQSNTDWGVLMLFGGGLTLSAVLKDSGASKILADSIVFMIDGQHFYLIGLLVAAFIIFLTEFTSNTASAALLVPIFISIAQSLGMPEIGLALIIGIGASCAFMLPVATPPNAIVFGSGQVKQSEMVKVGFLLNLVCVVVIATMGYMFWLK

SEQ ID NO: 3352 - protein, 282 aa, H. influenzae strain 86-028NP
MAAKIISGTELSKQIKANLADKITHYIEQGKRAPGLAVILVGADPASQIYVGNKRKSCEEVGILSKSYDLPETTTQNELLAIIDQLNADKNIDGILVQLPLPKQINAEAIIERIDPKKDVDGFHPYNVGRLCQRIPTLRACTPYGVMKLLETTGIDLHGKHAVIVGASNIVGRPMSLELLLAGATVTVTHRFTKNLENHVRQADILVVAVGKPNLISGDWIKESAVVIDVGINRVDGKLVGDVEFDKAAEKAAYITPVPGGVGPMTVAMLMSNTLYAYEHNK

SEQ ID NO: 3353 - protein, 428 aa, H. influenzae strain 86-028NP
MNAKVLEKKFIVPFVLITSLFALWGFANDITNPMVAVFQTVMEIPASEAALVQLAFYGGYGTMAIPAALFASRYSYKAGILLGLALYAIGAFLFWPAAQYEIFNFFLVSLYILTFGLAFLETTANPYILAMGDPQTATRRLNFAQSFNPLGSITGMFVASQLVLTNLESDKRDAAGNLIFHTLSEAEKMSIRTHDLAEIRDPYIALGFVVVAVFIIIGLKKMPAVKVEESGQISFKSAISKLAKKAKYREGVIAQAFYVGVQIMCWTFIVQYAERLGFTKAEGQNFNIIAMAIFISSRFISTALMKYLKAEFMLMLFAIGGFLSILGVIFIDGVWGLYCLILTSGFMSLMFPTIYGIALYGLKEESTLGAAGLVMAIVGGALMPPLQGMIIDQGEVMGLPAVNFSFILPLICFVVIAIYGFRAWKILK

SEQ ID NO: 3354 - protein, 216 aa, H. influenzae strain 86-028NP
MNRAELSQKIIDTCLEMTKLGLNQGTAGNVSVRYKDGMLITPTGMPYHLMKTENIVYVDGNGKHEENKLPSSEWQFHLSVYHTRPEANAVVHNHSIHCAGLSILEKPIPAIHYMVAVSGTDHIPCVPYATFGSHELASYVATGIKESKAILLAHHGLITCGENLDKALWLAQEVEVLASWYLKLLSTGLEIPLLSKEQMQVVLGKFHTYGLRIEES

SEQ ID NO: 3355 - protein, 144 aa, H. influenzae strain 86-028NP
MLKGIHPALSPELLKTLAEMGHGDEIVLADAHFPAHSLHKNVIRADGISIDILLEAITPLFEFDAYVDAPLLMMKAVEGDSLDPNVETRYLNAIESAVGFTPNLTSLERFDFYTRAKQAYAVVVSGEIAKYGNIIIKKGVTPIL

SEQ ID NO: 3356 - protein, 470 aa, H. influenzae strain 86-028NP
MAIALIFDCGATNLRTIAINEKGQILASHHLANNTKQGIESSDYHIWDIEEIWQKLISCATQTFNQLIQQGIDLKDIVGISVTTFGVDGAPFDKNDQQLYPIISWKCPRTIPVMENLSNQLDIKSLYQRNGIGQYSFNTLFKLHWLKTHKPDVFQKMAKFVFISSMLTQRLTGQFTTDHTMAGTSMMTNLTSGNWDPSILASLGLSNNHFPPMRYAGEKVGKLRTPLAQKWGLNPVPVISCGHDTQFAVFGSGAGLNQPVLSSGTWEILMARTQHAEPRFEFVSQGLTTEFDAQSNCFNPAVQWVGSGVIEWLGKLLFSDVYGSDHYYTTMIKEGEKAFNAGKRAVNFEGIFSQKGQGNISGLSMFATRGEIYVSALQHMANKLKNGLSVLHQVSQFQAKSLICVGGGSKNVLWNQIRANTLNLPIDVVDISESTVLGAAMFTFAGVGIYENVNAAQQAMQPTRKRIYPN

SEQ ID NO: 3357 - protein, 604 aa, H. influenzae strain 86-028NP
VISSFLLKHKQRSVTMALATQLNRIKIGIRPTIDGRRMGVRESLETQTMRMAQSVAQLLQTHIRHTDGTFVECVVADSTIGGVAEAAVCADKFKRENVGLTITVTPCWCYGSETIDMDPHMPKAIWGFNGTERPGAVYLAAALAGHSQLGLPAFSIYGTEVQEADDTNIPEDVKEKLLRFARAGLAVASIRGKSYLSIGSVSMGIAGSIVNQAFFQEYLGMRNEYVDMMEIKRRLDRKIYDQEEVDLALSWVKQYCKEGVDVNSLENQRNAEERAELWENVVKMTIITRDLMVGNPKLATLNYAEEALGHNAIAAGFQGQRHWTDHLPNGDFMEAMLNSTYDWNGVRPPYILATENDSLNAIGMLFGHQLTGKAQIFADVRTYWSQDSVERVTGWRPESGFIHLINSGSAALDGTGEHQDAQGNPTLKPAWDVTEEEAKRCLENTRWCPAVHEYFRGGGLSSQFLTKGGIPFTMHRINLIKGLGPVLQIAEGWSIDLPQDVHNKLNQRTNETWPTTWFVPRLTGKGAFTDVYSVMANWGANHCVATHGHVGADLITLASMLRIPVCMHNVSEKNIFRPSAWNGFGQDKEGQDYRACQNFGPLYK

SEQ ID NO: 3358 - protein, 249 aa, H. influenzae strain 86-028NP
MNYRDELILQWVNQQGKASVIELAQHCDISVETIRRDLNKLANKGLLHRTHGGAVSNKTKDLGSFFQTRKHINATAKRHIAQKALDLLYENAVIGLDASSTSWYFAYLMPDIPCTVVTNSMFNINALVNKSNVKTIVTGGVYSAKYEAFYGPLSEYLLQRLHINFSVFSCSGIDQNGNIWESNELNASLKRKMIEASERAYLLIDSSKFEKKSLIQLTDLSKINTIFSDQPLPDNLQKYCELHDIMTVL

SEQ ID NO: 3359 - protein, 923 aa, H. influenzae strain 86-028NP
MPFAIGQRWLSESENALGLGVITALDQRTVTIYFPAADETRIYAAAQAPLSRIVFSKGETLSHQAGWQGEILDVQNMNGLLFYLVKTPQDEDVIVQERDISPIISFSQAKDRLFSAQIDRSSHFALRYRTLCHQQAQFKSPLRGLRGTRAGLIPHQLHIAAEVGNRVNPRVLLADEVGLGKTIEAGMILQNQLFAEKVQRVLIIVPETLQHQWLVEMLRRFNLHFSLFDEERCNDFDLDAVNPFMTESLIICSLNWLETHPNRVEQALDAQFDCLIVDEAHHLVWSESAPSAAYLLVEQLARIIPSVLLLTATPEQLGQESHFARLRLLDPERFFDYQTFVKEQKRYQPVVNAIESLLANKALSAVEKNHISDLLLEQDVEPLFKAIASNNDEEQHRARQELIQALIDRHGTGRMLFRNTRQGVKGFPHRVYHQITLSEENDKIDWLINFLKLHRDEKIFVICQTAATAIQLEQILREREAIRAAVFHEKMSIIERDRAAAYFADLENGAQVLLSSSIGSEGRNFQFAANLVLFDLPTNPDLLEQCIGRLDRIGQKRDVQIYVPCAKDSPQIRLARWYNEGLNAFEQTCPMGMALFSQFEDELEKVRSNSTALSENEFSELLKQTKTVREKLKIELEKGRDRLLELNSNGGKQAQALADQIADEDNSPELVNFALKLFDIIGVEQEDLGANSIVISPTGTMLVPDFPGLKEEGVTVTFDRELALAREEMEFLTWDHPMIRQGIDLVASGDIGKAAMALLVNKQLPAGTLLIELIYIVESQSPKGLQLNRFLPPTPIRLLLDNKGNNIGEQVAFETLHSKLKPLGKNIANQMVKMARGNIEALITRGDQLVKSLAEPIITEAKNQADQQLSAEINRLQALRAVNQNIRQSEIDILEQQRTQSLDELSKANWRLDCLRVIVTNKE

SEQ ID NO: 3360 - protein, 219 aa, H. influenzae strain 86-028NP
MALIEYNPPLEPYLDIIYQDNHLCVVNKPSGLLSVPGNQPQYYDSAMSRVKEKFGFCEPAHRLDMATSGIIVFALSKAADRELKRQFREREPKKHYQAIVWGHLEKDYGEVNLPMICDWENRPRQRLDFVLGKRAVTKFEVLARLPNNSTRVKLTPVTGRSHQLRLHMLALGHPILGDKFYSHPQAKAMSPRLCLHAEELTITHPITGETMTFNAKSDF

SEQ ID NO: 3361 - protein, 192 aa, H. influenzae strain 86-028NP
MKNFLAQQGKITLILTALCALIYIAQQLGFEDDIMYLMHYPAYEEQDSEAWRYISHTLVHLSNLHILFNLSWFFIFGGMIERTFGSVKLLMLYVVASVITGYVQNYVSGPAFFGLSGVVYAVLGYVFIRDKLNHHLFDLPEGFFTMLLVGIALGFISPLFGVEMGNAAHISGLIVGLIWGFIDSKLRKNSLE

SEQ ID NO: 3362 - protein, 255 aa, H. influenzae strain 86-028NP; identical to SEQ ID NO: 644

SEQ ID NO: 3363 - protein, 273 aa, H. influenzae strain 86-028NP
MKLKQLFAITAIASALVLTGCKEDKKPEAAAAPLKIKVGVMSGPEHQVAEIAAKVAKEKYGLDVQFVEFNDYALPNEAVSKGDLDANAMQHKPYLDEDAKAKNLNNLVIVGNTFVYPLAGYSKKIKNVNELQDGAKVVVPNDPTNRGRALILLEKQGLIKLKDANNLLSTVLDIVENPKKLNITEVDTSVAARALDDVDLAVVNNTYAGQVGLNAQDDGVFVEDKDSPYVNIIVSRTDNKDSKAVQDFVKSYQTEEVYQEAQKHFKDGVVKGW

SEQ ID NO: 3364 - protein, 229 aa, H. influenzae strain 86-028NP
MFNDFLATFSQQLTPQMWGVVATATYETVYISFASTLLAVVVGVPVGVWTFLTGKNEILQNNRTHFMLNTIINIGRSIPFIILLLILLPVTRFIVGTVLGTTAAIIPLSICAMPFVARLTANALMEIPNGLTEAAQAMGATKWQIVRKFYLSEALPTLINGITLTLVTLVGYSAMAGTQGGGGLGSLAINYGVYRNMPYVTWVATIIIVLFVMISQKLGDTLARKVDHR

SEQ ID NO: 3365 - protein, 345 aa, H. influenzae strain 86-028NP
MIKLNNITKIFELPNKKLTALDNVSLNIEKGQICGVIGASGAGKSTLIRCVNLLEKPTSGSVIVDGVELTKLSDRELVLARRQIGMIFQHFNLLSSRTVFENVALPLELESESKAKIQEKITALLDLVGLSEKRDAYPSNLSGGQKQRVAIARALASDPKVLLCDEATSALDPATTQSILQLLKEINRTLGITILLITHEMEVVKQICDQVAVIDQGRLVEQGTVGEIFANPKTELAQEFIRSTFHISLPDEYLENLTDTPKHSKAYPIIKFEFTGRSVDAPLLSQASKKFGVELSILTSQIDYAGGVKFGYTIAEVEGDEDAITQTKVYLMENNVRVEVLGYVQ

SEQ ID NO: 3366 - protein, 184 aa, H. influenzae strain 86-028NP
MNKAIFLDRDGTLNIDYGYVHEIDNFKFIDGAIDALRELKKMGYMLVLVTNQSGIARGYFSEDQFLQLTEWMDWSLAEQDVDLDGIYYCPHHSEGKGEYKEDCDCRKPKSGMLLQAIKELKIDPTQSIMVGDKVEDLKAGIGAKVKMNVLVRTGKPVTGEGEGIADYVLDSIVDLPRILKRLKK

SEQ ID NO: 3367 - protein, 186 aa, H. influenzae strain 86-028NP
MARKKKTRRITDIMPIRKADKKIDITKARSGKKLTRYELDAKAREDKKKRKHKGLASGSRHSAVEEKANKLQNEIKDPKIGSKKKIPLVVEFVNKPEKGQVIPVIKQVKKQDPMKELENLENNEILNELLDALDAGKTISKSDQQFVDECLDRISELMEELGIEDEDESEDDLYRTFERMDINQFR

SEQ ID NO: 3368 - protein, 146 aa, H. influenzae strain 86-028NP
MIWIFFVIALFLVTGLTLYAIRLLKQLKVQKELIAKAKNNRVIRLKESIDIIARAMQSGECNLSEGVIRLTMLLRPFGKNLSSYPAMANLYEVVRDMPTHDDRKLLEKRERMRLDLARESAEAQFEKNIKQELYILLEDIKSIELI

SEQ ID NO: 3369 - protein, 208 aa, H. influenzae strain 86-028NP
MQDKLKVLLIDDHPLMRRGIKQLVELDDNFEVVADVSSGTEGISVALQTSPDVIILDLNMKGLSGLDTLKGLRAEGVDARILILTVSDAKNDIYTLIDAGADGYLLKDTEPDTLLDQIKRIAQGEVILSDSIKNLLLERTHEDNPLDSLTDREMGVLRQIATGLSNKQIAAQLFISEETVKVHIRNLLRKLNVHSRVAATVLFFEQNR

SEQ ID NO: 3370 - protein, 415 aa, H. influenzae strain 86-028NP
MNFFQYKHNKLYAEDMPVQQLAEQFGTPLYVYSRATLERHWHAFDSAFGKRPHLICFAVKSCSNIGVLNIMAKLGSGFDIVSQGELERVLAAGGDASKVVFSGVAKSREEIMRALEVGIRCFNVESVSELKHINQIAGEMGKIAPISLRVNPDVDAHTHPYISTGLKENKFGVSVNEAREVYKLASTLPNIKITGMDCHIGSQLTELQPFLDATDRLIVLMEQLKEDGITLKHLDLGGGLGVTYTDETPPHPSDYANALLEKLKNYPELEIILEPGRAISANAGILVAKVQYLKSNESRNFAITDTGMNDMIRPALYEAYMNIVEIDRTLEREKAIYDVVGPVCETSDFLGKQRELSIAEGDYIAQCSAGAYGASMSSNYNSRARTAEVLVDGDQSYLIRRRETLQELWALESTI

SEQ ID NO: 3371 - protein, 43 aa, H. influenzae strain 86-028NP
VRERKMKKLLSILVLSAICIVTTGCGVKGSLYFPEKDQAQQTQ

SEQ ID NO: 3372 - protein, 101 aa, H. influenzae strain 86-028NP
MNIAEFHQNIEQVWQKIEEELENQGADVDCETQGSVFTITFDNRTQIVINKQEPLLELWIASKLGGFHFAFKNGDWVSNDGQRFWDCFVEACAAHGENVQF

SEQ ID NO: 3373 - protein, 619 aa, H. influenzae strain 86-028NP
MLDSPLPSKIIEKPTALSVLKSVFGYQSFRKGQEEVINAALNGQDALVVMATGNGKSLCYQIPALCFDGLTLVISPLISLMKDQVDQLQANGIEADFLNSSQTLEQQQQVQNKLISGQLKLLYVSPEKVMTNSFFQLISYSKVCFIAIDEAHCISQWGHDFRPEYTQLGGLKASFPDAPIMALTATADYATQKDILRHLNLKNLHKYIGSFDRPNIRYTLEEKYKPMEQLTRFVLAQKGKSGIIYCNSRNKVERIAESLRNKGVSAAAYHAGMETAIRERVQQDFQRDNVQVVVATIAFGMGINKSNVRFVAHFDLPRSIESYYQETGRAGRDDLPAEAVLFYEPADYAWLQKILFEKPETPQRQIEQHKLEAIGEFAESQTCRRLVLLNYFGEHRQTPCNNCDICLDPPKKYDGLVDAQKVMSTIYRVGQCFGAHYVIAVLRGMHNQKIIERQHHKLSVYGIGKDKSKEHWQSVIRQLIHLGFVQQVISELNPTLQLTESAKVILKGEEPLELAMPRISSISKIAHNPQRQGVANYDKDLFARLRFLRKQIADKENIPPYIVFNDATLQEMAQYMPTSNIEMLQINGVGSIKLERFGQPFMALIQEHKAILANAQNND

SEQ ID NO: 3374 - protein, 572 aa, H. influenzae strain 86-028NP
MRTSQYLFSTLKETPNDAQVVSHQLMLRAGMIRPMASGLYNWLPTGIRVLKKVEKVVREEMNKGGAIEVLMPVVQPAELWEESGRWDQYGPELLRFEDRGNRNFVLGPTHEEVITDLVRREVSSYKQLPLNLYQIQTKFRDEVRPRFGVMRSREFIMKDAYSFHTTQESLQATYDVMYQVYSNIFRRLGLDFRAVQADTGSIGGSASHEFQVLASSGEDDVVFSTESDFAANIELAEAIAIGERQAPTAEMCLVDTPNAKTIAELVEQFNLPIEKTVKTLIVKGADENQPLVALIIRGDHELNEIKAQKHPLVADPLEFADETEIKAKIGAGVGSLGAVNLNIPAIIDRTVALMSDFSCGANIDGKHYFNVNWVRDVAMPEVFDLRNVVEGDPSPDGKGTLQIKRGIEVGHIFQLGKKYSEAMKATVQGEDGKPLVMTMGCYGIGVTRVVASAIEQHHDDRGIIWPSDEIAPFTVAIVPMNMHKSEAVQKYAEELYRTLQSQGVDVIFDDRKERPGVMFADMELIGIPHMVVIGEKNLDNGEIEYKNRRTGEKEMISKDKLLSVLNEKLGNL

SEQ ID NO: 3375 - protein, 782 aa, H. influenzae strain 86-028NP
MNKKHTLISLAILTALYSQQSLADLHEQCLMGVPKFSGEVVTGDVNSLPVYIEADNAEINQPNDATYQGNVDLKQGNRHLLAQSVQVKQSGNQSTPLRMAYVRNGFDYKDNQINMLGKDAEFNLDSHDGNLTNSEYEFVGRQGRGKADNITLHNNYRVMKNATFTSCLHGDNAWAVDASEIRQYVKEEYAEMWHARFKIHGVPVFYTPYLQLPIGDRRRSGLLIPSAGTSNRDGLWYAQPIYWNIAPNYDLTFTPKYMSRRGWQANGEFRYLTSIGEGKVAGEYLGKDRYSEYASDNRKRHLFYWNHNSSFLQNWRLNINYTRVSDKRYFNDFDSIYGRSTDGYANQYARIAYYQPNYNFSLSAHQFQIFDDIVNIGPYRAVPQLDFNYHKYDLANGWLNFKLHSQAVRFDNDSKLMPTAWRFHAEPSLNSLMSNKYGSLNIETKLYATRYEQKKGSGKNAEDVQKTVNRVIPQFKVDLQSVLSRDITFLKEYTQTFEPHVQYLYRPYRNQSNIGSTLNNDYLGFGYDSALVQQDYYSLFRDRRYSGLDRISSANQVTLGGTTRFYDIAGEERFNLSAGQIYYLSNSRIDENPANKTPTSSSAWALESNWKISNKWYWRGSYQFDTHTNSTSLANTSLEYNPEKNNLIQLNYRYVNQEYIDQNLGKSANAYQQDIQQVGLVVGWEIANNWAVVGRYYQDLALQKPVEQYLGVQYNSCCWAASVGVKRNVTNHQNQTRNEIVYDNSIGITLELRGLGSNDHQSGIQEMLEKGKLPYIRAFSLD

SEQ ID NO: 3376 - protein, 469 aa, H. influenzae strain 86-028NP
MPRLSRRQLLKTAAISTALSTVPAPLLAASREKLVVPPLIEVRRGRPIVLTMQETNYPLDGSHNVTVWGFNGNYLGPTIKIKSGSFAKLNYHNNLPQSVALSIQGLQASGELFGGAARVLKKGESWAPIVPIEQPAASCWYRSATLANSAYQTYRGLAGMWLIEDEQSLKANLPNKYGVDDIPLILQDMEFNNDGLQLFKQNQPHFVGNRLLVNGIEAPYLDVARGWIRLRLLNASLARAYDLRLDNDQEMLLIAQDLSFLPKAKSVKSLVLSPGERAEILVNMNEIDNVSLISGSKRSLYEKIKNMLFSGDELANNTVLELRAQGQLSAFNKQPNLTFETDAPAILQQAVAQTREFNIDVTNGLINQRRFDPRKVDVMARKGTIERWILNASLPVGFTIQGAKFVVESQGEHQLQAEELAWKDTVWVKNKTQILVKFDQASSGNFPFLFGVSNLMLEDMGCLGVLMVQ

SEQ ID NO: 3377 - protein, 240 aa, H. influenzae strain 86-028NP
MLKLLRIFLVLICCILICVLGTIYSFIRFKNPSNVGIVARWFGRLYPLFGLKVEHRIPQDQKQISRAIYIGNHQNNYDMVTISYMVQPRTVSVGKKSLIWIPFFGILYWVTGNIFLDRENRTKAHNTMSQLARRINEDNLSIWMFPEGTRNRGRGLLPFKTGAFHAAISAGVPIIPVVCSSTHNKINLNRWDNGKVICEIMDPIDVSGYTKDNVRDLAAYCHDLMEKRIAELDEEIAKGN

SEQ ID NO: 3378 - protein, 237 aa, H. influenzae strain 86-028NP
MKHSYFISDLHLSETQPELTALFVDFMQNLAPQAERLYILGDLFDFWIGDDEQSALIQQVKDLIKSVSNQGVQCYFQHGNRDFLIGERFAKDTGVQLLPDYQLITLYDKKILLCHGDTLCIDDEAYQQFRRRVHQKWLQRLFLCLPLKVRVIIAEKIRAKSNQDKQAKSQEIMDVNQAFTAEKVQEFDVNLLIHGHTHREAIHQQEEFTRIVLGDWRKNYASILKMDESGEFGFIKD

SEQ ID NO: 3379 - protein, 508 aa, H. influenzae strain 86-028NP
MVHSAPKAQKRETFSGRRAFILAAIGSAVGLGNIWRFPYTTYENGGGAFIIPYLIALLTAGIPLLFLDYAIGHRHRGGAPLSYRRVSPHFEVFGWWQMMVNVIIGLYYAVVLGWAASYTYFSFTGAWGDKPIDFFIGEFLKMGDIKNGISFEFVGMVTAPLIAMWIVALGVLSMGVQKGIAKVSSVLMPVLVVMFMVLVIYSLFLPGAAKGLDALFTPDWTKLSNPSVWIAAYGQIFFSLSIGFGIMVTYASYLKKESDLTGSGLVVGFANSSFEVLAGIGVFAALGFIATAQGQEVSEVAKGGIGLAFFAFPTIINKAPFGEVLGMLFFGALTFAALTSFISVIEVIISAIQDKIRISRGKVTFIVGVPMMLVSVILFGTTTGLPMLDVFDKFVNYFGIVAVAFASLIAIVANEKLGLLGNHLNETSSFKVGFFWRLCIVLTSGVLAFMLFSEGAKVFSEGYEGYPNWFVNTFGWGMSISLLVVAFFLSRLKWKSETKLTIDETKGE

SEQ ID NO: 3380 - protein, 208 aa, H. influenzae strain 86-028NP
MTGAQLIMACLKAHHVTTLFGYPGGAIMPTYDALYDAGLDHLLCRNEQGTAMAAIGYARSTGKVGVCIAASGSGATNLVIGLGDAMMDSIPVVTIEPWREQIRNFKAKLDFTYVENQGNRPIDPWALLNSLSNRKPNNAIICTDVGQHQMWSVQHILRVARHCGFTVTTMEMTLIETQVRLKITVKSDRTLDLLVNQLVKLPDVLMVN

SEQ ID NO: 3381 - protein, 612 aa, H. influenzae strain 86-028NP
MPKLRSATSTQGRNMAGARALWRATGMKENDFGKPIIAVVNSFTQFVPGHVHLKDMGQLVAAEIEKAGGVAKEFNTIAVDDGIAMGHGGMLYSLPSRDLIADSVEYMVNAHCADAMVCISNCDKITPGMLMAAMRLNIPTIFVSGGPMEAGKTKLSDQLIRLDLVDAMIEAADPNVSDERIDAIERSACPTCGSCSGMFTANSMNCLTEALGLSLPGNGSMLATHADRKELFLKAGRQIVELCKRYYEQDDASVLPRSIGTFDAFENAMSLDIAMGGSSNTVLHLLAAAQEAGVDFKMEDIDRLSRKVPCLSKIAPNTNKYHMEDVHRAGGIMGLLGELDRAGLIHKNTHTVLGMSMGEQLDQYDIIRNQDEELHKFFRAGPAGIRTTQAFSQDCRWDTVDNDRVNGCIRNKENAISQEGGLAVLFGNLAEDGCIVKTAGVDESIWKFTGTAIVFESQEDAVAGILGGKVKEGHVVVIRYEGPKGGPGMQEMLYPTSYLKSMGLGKKCALLTDGRFSGGTSGLSIGHASPEAASGGAIGLVRDGDIINIDIPNRAINLEISNDELAARRAEQDQKGWQPANREREVSFALKVFGHFATSADKGAVRDKTLLK

SEQ ID NO: 3382 - protein, 513 aa, H. influenzae strain 86-028NP
MKNLLTNPQPSQSDYINAIVKLGSRVYEAAQVTPLQKMGKLSERLHNNIWIKREDRQPVNSFKLRGAYAMISSLSEEQKAAGVIAASAGNHAQGVALSAKQLGLKALIVMPQNTPSIKVDAVRGFGGEVLLHGANFDEAKAKAIELSKEKNMTFIPPFDHPLVIAGQGTLAMEMLQQVADLDYVFVQVGGGGLAAGVAILLKQFMPEIKIIGVESKDSACLKAALDKGEPTDLTHVGLFADGVAVKRIGDETFRLCQQYLDDMVLVDSDEVCAAMKDLFENVRAVAEPSGALGLAGLKKYAKQNHIEGKNMAAILSGANLNFHTLRYVSERCEIGENREALLAVTMPEQPGSFLKFAYVLGNRAVTEFSYRYADDKRACVFVGVRTTNEQEKADIIADLTKNGFDVEDMSDDDIAKTHVRYLMGGRASNDNERLYTFEFPEQKGALLKFLETLQNRWNISLFHYRAHGADYGNILAGFQIEEREQAEFEQALAQLNYVFEDVTESKSYRYFLR

SEQ ID NO: 3383 - protein, 1150 aa, H. influenzae strain 86-028NP
LRTHTDFSMIDSIVKVKPLVKACAANEMVAMGLTDFTNFCGVVSFYSEMLSSGMKPIIGADVKVKSPLCGDEYFDLTLLAKNNEGYRNITLLLSKAYQRGYNDLPYIDQDWLIEHRDGVIILSGGTQGDVGKKLLKENVAEIESAVAFYQEFFADHFYLALSRTGRPNEERYIQAALKLAERCDLPLVATNDVMFLNAEDFEAHEIRVAIHDGYTLDDPKRPKCYTSQQYFRSEEDMCKLFADIPSALENTLLIAQRCSVTLRLGQYFLPQFPTGDLSTEDFLVQKSKEGLEERLVFLFPDEKVRLEKRPKYDERLQVELDVINQMGFPGYFLIVMEFIQWSKDNDIPVGPGRGSGAGSLVAYALKITDLDPLEFDLLFERFLNPERVSMPDFDVDFCMDGRDRVIEHVAETYGRGAVSQIITFGTMAAKAVIRDVGRVLGHPYGFVDRISKLIPPDPGMTLAKAFETEPQLQTAYDSDEEVRALINMARKLEGVTRNAGKHAGGVVISPTLITDFAPLYCDNEGLHPVTHFDKNDVEYAGLVKFDFLGLRTLTIIKWALDIINVRMVREGKPRVDIAAIPLDDPESFELLKRSETTAVFQLESRGMKDLIKRLQPDCFEDIIALVALFRPGPLQSGMVDNFIDRKHGREEVSYPDAEYQHASLKPILEPTYGIILYQEQVMQIAQVLAGYTLGGADLLRRAMGKKKPEEMAKQRLVFKEGAEKNGVDGELSMKIFDLVEKFAGYGFNKSHSAAYALVSYQTLWLKTHFPAEFMAAVMTSEMDNTDKIVGLYDECLRMGLKVTPPDINIGKHHFSVNEQGEIVYGIGAIKGVGEGPIEALVAARNEGGIFKDLFDLCARVDLKKINRRTFESLIMSGAFDKLGPHRAALSKNLEDALRASDQHAKDEAMGQTDMFGVLTETHEDVENAYANTPPYTEKQILDGERETLGLYLSSHPVSRYLKELSHYTSTRLKDLAPNRRGQISTVAGLVVASRIAMTKKGNRLGIATLDDRSGRLDLTLFGESLEQFGEKLQKDTVIVASGQVSFDDFSGGLKMTVRELMTLDEARSRYVKSLAISLSEHQITPSFIKQFKALLEPVSGGTLPINVYYQSPKGRALLRLGVQWSIIPTDEILTELVNLLGESAVELEFE

SEQ ID NO: 3384 - protein, 547 aa, H. influenzae strain 86-028NP
MTTLFEVAQHWLNQDPDTETRAELTALLDAAKGGDKAAEAELHARFDGRLQFGTAGLRGRLQAGSIGMNRVLVSQAAGGLAEYLKGYDKEPSIVIGYDGRKNSDVFARDTAEIMAGAGVKAYLLPRKLPTPVLAYAIQYFDTTAGVMVTASHNPPEDNGYKVYLGKANGGGQIVSPADKDIAALIDKVAAGNIQDLPRSDNYVVLNDEVVDAYITKTASLAKEPACDINYVYTAMHGVGYEVLSKTLAKAGLPQPHVVADQVWPDGTFPTVNFPNPEEKGALDLAIKVAKEKNAEFIIANDPDADRLAVAVPDAQGNWKSLHGNVVGCFLGWYLAKQYQGKQGTLACSLVSSPALAEIAKKYGFQSEETLTGFKYIGKVSGLLFGFEEALGYLVDPDKVRDKDGISAAIVFLDLVRNLKKQGKTLADYADEFTKEFGAYVSGQISIRVSDLSEIGKLMTALRNNPPAEIAGVKVAQFIDHIKTDRQSDILVFNLENGGRLIARPSGTEPKIKFYLDARGKDPKDADCVLAEFDEGVRHILRQDTYGK

SEQ ID NO: 3385 - protein, 169 aa, H. influenzae strain 86-028NP
MSEQKQDVAATEEQQPVLQIQRIYVKDVSFEAPNLPHIFQQEWKPKLGFDLSTETTQVGDDLYEVVLNISVETTLEDSGDVAFICEVKQAGVFTISGLEDVQMAHCLTSQCPNMLFPYARELVSNLVNRGTFPALNLSPVNFDALFVEYMNRQQAENAEEKSEEEQTKH

SEQ ID NO: 3386 - protein, 148 aa, H. influenzae strain 86-028NP
MQEFISMATEFAQKHTLLAVSWFAIFVMVIYTFYKGATSKFKVITHNEVIRLINSDEAIVVDLRSLEEFQRGHIINSINVLPSEIKNQNIGKLESHKEKALILVDTNGTSASASAVFLTKQGFNSVFVLKEGLSAWVAANLPLVKKHK

SEQ ID NO: 3387 - protein, 440 aa, H. influenzae strain 86-028NP
MSAMFLLQFAIVLLCIFVGARVGGIGLGVFGGLGLAILSFGFGLKPAGLPIDVMFMIMAVVAAAAAMQAAGGLDYMIKIATKILRRNPKHITFIAPAVTWLFTLLAGTGHVAYSVLPVIAEVSRQNGIRPERPMSMAVIASQFAIVASPIAAAVVAVVAYLEPQGIHLGDVLMVTIPSTILGLFLACLFVNKMGKELKDDPEYQRRLNDPKYADIFASTTLVKEVEVSKTAKISVSLFLFGALLVVLMGAAPSIRPVFDGKPMGMAHTIEIIMLSIGALIILTCKPDGTAITKGSVFHAGMRAVIAIFGIAWLGDTLMQAHITEVKEMVKGLVETAPWAFAFALFVLSVLVNSQGATVATLFPLGIALGIPAPVLIGVFVAVNGYFFIPNYGPIIASLDFDTTGTTKIGKYILNHSFMLPGLLSMFFCLLIGLGLSHVIL

SEQ ID NO: 3388 - protein, 444 aa, H. influenzae strain 86-028NP
MKNVVIVGGGAGGIELATFLGNKLGRQKQAKVTLVDRNATHLWKPLLHEIATGVMDDGVDSLSYRAHGKNHFFSFEQGSIIRINREQKYVELAPVYGQEGDMLVIARRIPYDYLVIAIGSKSNDFNTKGVADNCIFLDSSKQALRFQHKLLELFLKFSENRALDDIGEEEFKQKLVDENKVNIAIVGGGATGVELTAELYHAAEDLSSYGYGKIDSSCLQVTLVEAGTRLLPALPENLSAAVLDELKEMGTNVQLNTMITEAQPNTLITKDGGEIKADLIVWAAGVRASTVTQQFDGLEINRINQLVVKDTLQTTVDDSIFAIGDCAALIQSNGKLVPPRAQAAHQMAKACAKNIFALFENKPLKSFKYNDKGTLVSLSNFTALGSLTNKFGKNPLTVQGKFAQFAYVSLYRMHQHALHGCIKIGLIILVDKLNRYLKPRLKLH

SEQ ID NO: 3389 - protein, 810 aa, H. influenzae strain 86-028NP
MANFINMYRQLLSLPLSALVKNNPIPANPIEELSLNIHQPIVYVLPYTSQTDFVIFRRNCLALGLPDPAEKNEINGVKLPRYVYLDEGRRIFKSKGAKDETTTIFNKYLELHRTSESLDVQLIPVSVLWGRSPGQEDKSDLPNLRLLNGIQKTFAAIWFGRDTFVRFSQAVSLRYMVVEHGSDEKIAQKLARVAKMHFAKQRISATGPRLPNRQAMFNKLLQSEAIRRAIEDEAKSKNISIEKAQKEAYKILDEIAADVSHSSLRAVDRFLRWLWNKLYSGIDVQNSNRVRKLALEGHEIVYVPCHRSHIDYLLLSYVLYHQGLVPPHIAAGINLNFWPIGRMFRSWGAFFIRRTFKGNRLYSAIFREYLSELFHRGYSVEYFIEGGRSRTGRLLAPKTGMMSMTLQALQHSQTRPISIVPVYVGYEHVLEVDTYAKELRGAAKEKENAGLVLRVIKKLRNLGQGFVNFGEPITLSNYLSQHFPDWKEQNHEEKPQWFTPAVNNISKQVMININKAAAVNSMNLVGTALLSSRQRALSREQLLEQLSSYQQLLQNVPYSTDVVLPNVTPQAMLEHVLALDRIGVLIEKDNFGEIVRLERSSAVLMTYYRNNIQHLFVLPSLVASIILHYEAIQKDLLLDAIRKIYPFLQGELFLHFNEDELNVQIHQIINEFARQSVINSNDNFLSINKSKVRILQLWSAGTREILQRYYITVTILQKQPAISRAELEKESQLVAQRLSVLHGINAPEFFDKAVFSSFIANLKEQRYFDESGYTVLDKIEELASTLSHLISTEICLTVKGTIEKSEDLSS

SEQ ID NO: 3390 - protein, 209 aa, H. influenzae strain 86-028NP
VYMRPLTARQQEVLDLLKRHLETTGMPPTRAEISRELGFKSANAAEEHLKALSRKGAIEIIPGASRGIRILDNSSNDEFDGLPLVGRVAAGEPILAEQHIEATYRVDADMFKPQADFLLKVYGLSMKNVGILDGDLLAVHSTKDVRNGQIVVARIEDEVTVKRLEKKGSIIYLHAENEEFDPIVVNLEEQKNFEIEGIAVGIIRNNAWM

SEQ ID NO: 3391 - protein, 274 aa, H. influenzae strain 86-028NP
MQFSKMHGLGNDFVVVDGVTQNVFFTPETIRRLANRHCGIGFDQLLIVEAPYDPELDFHYRIFNADGSEVSQCGNGARCFARFVTLKGLTNKKDISVSTQKGNMVLTVKDDNQIRVNMGEPIWEPAKIPFTANKFEKNYILRTDIQTVLCGAVSMGNPHCVVQVDDIQTANVEQLGPLLESHERFPERVNAGFMQIINKEHIKLRVYERGAGETQACGSGACAAVAVGIMQGLLNNNVQVDLPGGSLMIEWNGVGHPLYMTGEATHIYDGFITL

SEQ ID NO: 3392 - protein, 165 aa, H. influenzae strain 86-028NP
MTVTLAGNPIEVGGHFPQVGEIVENFILVGNDLADVALNDFAGKRKVLNIFPSIDTGVCATSVRKFNQQAVKLSNTVVLCISADLPFAQARFCGAEGIENAKTVSTFRNHALHSQLGVDIQTGPLAGLTSRAVIVLDEQNNVLHSQLVEEIKEEPNYEAALAVLA

SEQ ID NO: 3393 - protein, 1320 aa, H. influenzae strain 86-028NP
MQTFALFVIIRLFFYFSFIRNCNMTVKTFRGSPALSEFRLTQLQQKCQQYQLPITSVYAEYLHFVEQKTSLVEDEIVKLQALLHYGSMFSELKPAGYCLIVTPRVGTISSWSSKATDIAHNCGLSKVNRIERGIAYYFNIERDLTEAELATLKDLLHDRMLETVLNHETEAALLFTQQEPKALTTIDILNGGRQALERANIALGLALADDEMDYLVESFTALKRNPQDVELYMFAQANSEHCRHKIFNADWIIDGKKQDKSLFKMIKNTFEQTPDFVLSAYKDNAAVMEGSKVGRWFPDPDGQYRVHQEDAHILMKVETHNHPTAISPFPGAATGSGGEIRDEGATGRGAKPKAGLTGFSVSNLVIPNFEQPWENPLSKPNRIASALDIMIDAPLGSAAFNNEFGRPALLGYFRTYEEKVNSFAGKEVRGYHKPIMLAGGIGNIRGEQVQKGEIPIGAKLIVLGGAAMNIGLGGGAASSMDSGKSKEDLDFASVQRENPEMERRCQEVIDRCWQLGEENPILFIHDVGAGGLSNAMPELVHDGRRGGKFDLRSILCDEKGMSPLEIWCNESQERYVLAVAPENLELFTALCERERAPFAVIGEATQAEHLILHDSHFDNNPIDLPMNVLLGKTPKMTREVLSKTVENQSLKTEGIQLKEAFHRVLRLPVVAEKTFLITIGDRSVTGMVARDQMVGPWQIPVSDVAVTTASLDSYHGEAMAMGERSPVALLNFSASARLAVAEAITNIAGTHIGEMKRIKLSANWMSAAGHTGEDAGLYEAVKAVGEELCPALGLTIPVGKDSMSMKTTWIDNGEQKSVTAPLSLVISAFARVEDVRKTLTPQLRTDKGLSSLLLIDLGEGHNRLGATALAQVYKQLGDKPADVVKVQRLKDFYNAMQTLVAEDKLLAYHDRSDGGLITTLAEMAFAGHCGVEVDISALGDNDLAVLFNEELGAVIQVADSQLESVREVLKAHNLLGITHQLGTVTADDRFEISRGSHKLFSEKRSELRSIWAELTYQMQRLRDNPECAEQEFEAKKNPDDKGLSAFLTYDVNEDITAPFINKGVKPTIAILREQGVNSHYEMAAAFDRAGFNAIDVHMSDLMIGRRNLAEFNAMVACGGFSYGDVLGAGGGWAKSILFNPKLHEQFSQFFINPNTLTLGVCNGCQMISNLAEIIPGTENWPHFVRNKSERFEARVSLVKINEVDSVWFAGMAGSHMPIAVSHGEGQVKFKSVEQFAGLKAQGIIAAQYIDNNGSPTELYPANPNGSAEGITAITNLDGRVAIMMPHPERVFRAVSNSWHPENWTEDGAWMRLFRNARMVF

SEQ ID NO: 3394 - protein, 247 aa, H. influenzae strain 86-028NP
MFITPIFIINLEKSTDRKAYMQAQFEQLFSNNLIQEIHFFDAIYGKSNPNHPLFQRYNENKRLNAKGYPLTLGQLGCYASHYSMWEKCVELDYPIIVLEDDAKFKNNFLEVLDFINSDKNTFEFFWLQPDRLKNKRKLISNFGNLSIYQFSKGFAGATGYYLTPQAARKFLTQSKEWYLTVDVTMDRFFENKVPPYAIVPFCLEDDGEIESTIYEKQKKQRSLKIVIMRELFNLKTNIKRRIYNLFH

SEQ ID NO: 3395 - protein, 280 aa, H. influenzae strain 86-028NP
MNILIKSAVKNFIVFSTALYTSFSFAQSKLAIVIDDVGYHSKEDAAIFAMPREISVAIIPAAPYARARNQEAKSQGRDILIHMPMQPVSAVKIEDGGLHLGMSAAQVNDRVNTAKNIVRDAIGMNNHMGSAATADPQLMTYLMTALQEKHLFFLDSRTIGKSVAGKIAKEQGVRSLDRHIFLDDSNEFADVQRQFKAAIHYARKHGSAIAIGHPRQNTIAVLQAGLRNLPEDIQLVGMGNLWRNEKVIPHKPFILLFSEVPAPTSIEPFEPVGLLRGIPK

SEQ ID NO: 3396 - protein, 410 aa, H. influenzae strain 86-028NP
MLRFGVNQKTSLLLTALLSCGLLIFSPVSQSSDLNQIQKQIKQQESKIEKQKREQAKLQANLKKHESKINSVEGELLETEISLKEIRKQIADADKQLKQLEKQEREQKARLTKQIDIIYRSGINPSLIERMFAQDPTKAERMKVYYQHLNQVRIEMINNLKATQAQIAVQKKAIFSQQKNHRNQLSTQKKQQQALQKAQQEHQSTLNELNKNLALDQDKLNALKANEQALRQEIQRAEQAAREQEKREREALAQRQKAEEKRTSKPYQPTVQERQLLNSTSGLGAAKKQYSLPVSGSILHTFGSIQAGEVRWKGMVIGASAGTPVKAIAAGRVILAGYLNGYGYMVIVKHGETDLSLYGFNQAVSVKVGQLVSAGQVIAQVGNTGEISRSALYFGISRKGTPVNPAGWVR

SEQ ID NO: 3397 - protein, 227 aa, H. influenzae strain 86-028NP
MELVFIRHGFSEWNAKNLFTGWRDVNLTERGVEEAKAAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 3398 - protein, 70 aa, H. influenzae strain 86-028NP
MKQGIHPEYKEVTATCSCGNVIKTRSTLGKDINLDVCGNCHPFYTGKQRVVDTGGRVERFNSRFKIPSTK

SEQ ID NO: 3399 - protein, 378 aa, H. influenzae strain 86-028NP
MLAKSSINAPFAKSVLAWYDKFGRKHLPWQQNKTLYGVWLSEVMLQQTQVATVIPYFERFIKTFPNITALANASQDEVLHLWTGLGYYARARNLHKAAQKVRDEFNGNFPTNFEQVWALSGVGRSTAGAILSSVLNQPYPILDGNVKRVLARYFAVEGWSGEKKVENRLWALTEQVTPTMRVADFNQAMMDIGAMVCTRTKPKCDLCPLNIDCLAYKNTNWEKFPAKKPKKAMPEKTTYFLILSKNGKVCLEQRENSGLWGGLFCFPQFEDKSSLLHFLAQEKVTHYQEWPSFRHTFSHFHLDIHPIYAEMESALCVEQANLDWRKVMESTKEYQSNLSSAVKYWYDPQNPEPIGLAQPVKNLLIQFVRNHYGKNSIL

SEQ ID NO: 3400 - protein, 90 aa, H. influenzae strain 86-028NP
MARTVFCEYLKKEAEGLDFQLYPGELGKRIFDSVSKQAWGEWIKKQTMLVNEKKLNMMNAEHRKLLEQEMVNFLFEGKDVHIEGYVPPSN

SEQ ID NO: 3401 - protein, 357 aa, H. influenzae strain 86-028NP
MKKYLLLALLPFLYACSNSSNQGINYDEAFAKDTQGLDILTGQFSHNIDRIWGVNELLVASRKDYVKYTDSFYTRSHVSFDEGNIVIETQQDLNRLHNAIVHTLLMGADAKGIDLFTSGDVPISSRPFLLGQVVDHQGQQIANQVIASNFATYLIQNKLQTRRLQNGHTVQFVSVPMIANHVEVRARKYLPLIRKAAQRYGIDESLILGIMQTESSFNPYAISYANAIGLMQVVPHTAGRDVFAMKGKGGQPSTRYLYDPANNIDAGVSYLWILQNQYLDGITNPTSKRFAMISAYNSGAGAVLRVFDNDKDTAIYKINQMYPEQVYRILTTVHPSSQARNYLLKVDKAQKKFRVRR

SEQ ID NO: 3402 - protein, 226 aa, H. influenzae strain 86-028NP
MILFAGDPHGSYDHIYPFIKEQENVALIILGDLQLTTADELDKLAQHCDIWFIHGNHDSKTISAFNAIWGSKWQSRNLHNRIVDIQGTRIAGLGGVFRGQIWMPPNRPMFFDPIHYCQYSPQEKIWRGGVPLRHRTSIFPSDIEILENQQADVLICHEAPKPHPMGFQVINDLAMKMGVKLVFHGHHHENFTYRTKYPYKITNVGFRSLADAEGNYLLQTIDDREK

SEQ ID NO: 3403 - protein, 421 aa, H. influenzae strain 86-028NP
VGFTTGREFHPALRMRAKYNAKYLGTKSEREKYFHLAYNKHTQFLRYQEQIMSKTKEKKVGVIFGKFYPVHTGHINMIYEAFSKVDELHVIVCSDTVRDLKLFYDSKMKRMPTVQDRLRWMQQIFKYQKNQIFIHHLIEDGIPSYPNGWQSWSEAVKTLFHEKHFEPSIVFSSEPQDKAPYEKYLGLEVSLVDPDRTFFNVSATKIRTTPFQYWKFIPKEARPFFAKTVAILGGESSGKSVLVNKLAAVFNTTSAWEYGREFVFEKLGGDEQAMQYSDYPQMALGHQRYIDYAVRHSHKIAFIDTDFITTQAFCIQYEGKAHPFLDSMIKEYPFDVTILLKNNTEWVDDGLRSLGSQKQRQQFQQLLKKLLDKYKVPYIEIESPSYLDRYNQVKAVIEKVLNEEEISELQNTTFPIKGTSQ

SEQ ID NO: 3404 - protein, 215 aa, H. influenzae strain 86-028NP; identical to SEQ ID NO: 624

SEQ ID NO: 3405 - protein, 282 aa, H. influenzae strain 86-028NP
VKISMIFLPHFLYYTVPTFYLFGLLIMHNAAQHNYVISLTTEQKRRKHITDEFGKQNIPFEFFDAITPDIIEETAKKFNIALDRSPKAKLSDGEIGCALSHIVLWDLALENNLNYINIFEDDIHLGENAKELLEIDYISDDIHVLKLEANGKMFFKQPKSVKCDRNVYPMTVKQSGCAGYTVTAKGAKYLLELVKNKPLDVAVDSLVFEDFLHFKDYKIVQLSPGICVQDFVLHPDNPFESSLQEGRDRVHGNQRKFSILEKIKNEFGRVKIKMFGKQVPFK

SEQ ID NO: 3406 - protein, 160 aa, H. influenzae strain 86-028NP
MLDIVLYEPEIPQNTGNIIRLCANTGFRLHLIEPLGFTWDDKRLRRSGLDYHEFAEIKRHKTFEAFLESEKPKRLFALTTKGSPAHSQVKFELGDYLMFGPETRGIPMSILNEMPMEQKIRIPMTANSRSMNLSNSVAVTVYEAWRQLGYKGAVNLPEVE

SEQ ID NO: 3407 - protein, 193 aa, H. influenzae strain 86-028NP
MKKIQTPNAKGEVRIIAGLWRGRKLPVLNSEGLRPTGDRVKETLFNWLMPYIYQSECLDGFAGSGSLGFEALSRQAKKVTFLELDKTVANQLKKNLQTLKCSSEQAEVINQSSLDFLKQPQNQPHFDVVFLDPPFHFNLAEQAISLLCENNWLKPNALIYVETEKDKPLITPENWTLLKEKTTGMVSYRLYQN

SEQ ID NO: 3408 - protein, 414 aa, H. influenzae strain 86-028NP
MNDIFIGLQLREHFMAEENKKGGFWASLFGRNKKQDEPKIEPIIEEEKIKDIEPSIEKFETHDLVEEEKIQEISTALEPIEEIIEAKKLEDELQPVAEIETREKPSEGGFFSRLVKGLLKTKQNIGAGFRSFFLGKKIDDELFEELEEQLLIADIGVPTTSKIVKNLTEHASRKELQDAELLYQQLKVEMADILEPVARPLEIDSTKKPYVILMVGVNGVGKTTTIGKLARKFQAEGKSVMLAAGDTFRAAAVEQLQVWGERNHIPVVAQSTGSDSASVIFDAMQSAAARNIDILIADTAGRLQNKNNLMDELKKIVRVMKKYDETAPHEIMLTLDAGTGQNAISQAKLFNEAVGLTGISLTKLDGTAKGGVIFAIADQFKLPIRYIGVGEKIEDLREFNAKEFIEALFVHEEE

SEQ ID NO: 3409 - protein, 218 aa, H. influenzae strain 86-028NP
VIKFSNVSKAYHGATQPALQGLNFHLPVGSMTYLVGHSGAGKSTLLKLIMGMEKANAGQIWFNGHDITRLSKYEIPFLRRQIGMVHQDYRLLTDRTVAENVALPLIIAGMHPKDAHTRAMASLDRVGLRNKAHYLPPQISGGEQQRVDIARAIVHKPQLLLADEPTGNLDDELSLGIFNLFEEFNRLGMTVLIATHDINLIQQKPKPCLVLEQGYLRY

SEQ ID NO: 3410 - protein, 310 aa, H. influenzae strain 86-028NP
MSRSTDASVFVQTAYTLRAVWADLWQRKFGTLLTILVIAVSLTIPTVSYLMWKNLHLATTQFYPDSELTIYLHKNLSEENANLVVEKIRQQKGVESLNYVSRQESLKEFKSWSGFGEELEILDDNPLPAVVIVKPTSEFNVSEKRDELRTNLNKIKGVQEVRLDNDWMEKLTALSWLTAHVAIFCTVLMTIAVFLVIGNSIRSDVYSSRSSIDVMKLLGATDQFILRPYLYTGMIYAVLGGLVAAIFSSFIISYFTSAVKYVTDIFAVQFSLNGLGVGEFVFLLVCCLIMGYVGAWIAATRHIAMMERKE

SEQ ID NO: 3411 - protein, 393 aa, H. influenzae strain 86-028NP
MENVVIVSAVRTPIGSFNGALSSVSAVDLGAIVIQEAIKRANIESALVNEVIMGNVLQAGLGQNPARQAALKAGIEKEIPSLTINKVCGSGLKSVALGAQSIISGDADIVVVGGMENMSQAPYLLDSKVRQGVKMGNLTLRDTMIEDGLTCASNHYHMGITAENIAEQYGISRQAQDELALRSQTLASQAVQLGVFDKEIIPVMVKTRKGDIIVSRDEYPKADTTAEGLAKLKPAFKKEGTVTAGNASGINDGAAALILVSESKAHALGLKAIAKIRSYASGGVDPSVMGLGPVPATQKALKKAGINLDDIDLIEANEAFASQFLGVGKDLNLDMNKTNIHGGAIALGHPIGASGARILVTLLHNLIEKDKKLGLATLCIGGGQGISMIVERL

SEQ ID NO: 3412 - protein, 447 aa, H. influenzae strain 86-028NP
MISRVSRFMTTFVSKYLPDPLIFAVLRTFVTFICAWGLTDSTPVDLVNMWGNGFWNLLGFGMQMALIVVTGNALATSPQIRKFLSTIASIAKTPAQGVVLVTFMGSIACIINWGFGLVVGAMFAKEVARRIKGSDYALLIACAYIAFMTWGGGFSGSMPLLAATPGNPVAHLMVSESNPQGIIPAVSTLFSGYNIFITLSLVICLPFITYMMMPKNGEAKSIDPKLIAPDPTFDKKLDKDATLAEKMEESRFLAYTIGALGYSYLGMYFYKNGFNLTINNVNLIFLITGIVLHGSPMAYMRAIINATRSTAGILVQFPFYAGVQLMMEHSGLGGLITEFFINVANKDSFPLLTFFSSAFINFAVPSGGGHWVIQGPFVIPAAQALGTDLGKSTMAIAYGEQWMNMAQPFWALPALGIAGLGVRDIMGFCMTALIFTAPIFIIGLYFL

SEQ ID NO: 3413 - protein, 221 aa, H. influenzae strain 86-028NP
MNAKELIARRIAMELHDGDIVNLGIGLPTQVVNYLPDNVNITLQSENGFLGLTAFDPENANSNLVNAGGQPCGIKKGGATFDSAFSFALIRGGHVDACVLGGLEVDQEANLANWMVPGKMVPGMGGAMDLVTGAKKVIIGMEHCAKSGSSKILKKCTLPLTASKKVAMVVTELAVFNFIEGRLVLKEHAPHVDLETIKAKTEADFIVADDFKEMQISQKGL

SEQ ID NO: 3414 - protein, 217 aa, H. influenzae strain 86-028NP
MTQKHLKLNNLNQHLHDGMSIMFGGFMGIGTPAKLVQQILDSGVKDLTLIGNDTAFIDTGVGPLIVNNRVKRLITSHIGTNPETGKKMIAGEIDVELVPQGTLAERIRAGGAGLGGILTPTGVGTVVEEGKQKIQIDGKEYLLELPLKADIAIIHAQKGDMNGNLAYELSARNFNPLVALAAKTVIAQVDNLLEVGQLPPDEVITPAALIDYIVCSE

SEQ ID NO: 3415 - protein, 315 aa, H. influenzae strain 86-028NP
VLYFVKMAVLRGVKMMDIRHLRYFVSIVDNDFNLSRASQNLYVSQPALSMMITEFENRENIQIFKRASGKIIGLTFAGENYYRDAKEVIKRYNDMRTNLYKSKDCKKGTITIGIPPLVLSAVFSSVLPHLILKNPDINFIIKEIGAYALKSELLLDKVDLAVLLYPERISKNIIDSIEIHSSELALFLSPKHVLAKKQQITWADLHQQKMAIFDQTFMIHHHLKEAFERNNCYPDIVLDSSCWDFLLSAVKTNKELLTILPLPMAELYHSKEFLCRKIESPVPWKVTLCRQRKTVYTHLEEYIFDKLLEAFRPTK

SEQ ID NO: 3416 - protein, 103 aa, H. influenzae strain 86-028NP
MQNQRIRIRLKAFDHRLIDQSTAEIVETAKRTGAQVRGPIPLPTRKERFTVLISPHVNKDARDQYEIRTHKRLVDIVEPTEKTVDALMRLDLAAGVDVQISLG

SEQ ID NO: 3417 - protein, 208 aa, H. influenzae strain 86-028NP
MIGLVGRKVGMTRIFNEDGVSVPVTVIEIEANRVTQVKTLENDGYTAVQVTTGSKKANRVTKPEAGHFVKAGVEAGRGLWEFRTEGEEFTLGQEINVDIFADVKKVDVTGTSKGKGFQGGVKRWNFRTQDATHGNSLSHRVLGSIGQNQTPGRVFKGKKMAGHLGAERVTVQSLEVVRVDAERKLLLVKGSVPGAINGDVIVKPAVKA

SEQ ID NO: 3418 - protein, 200 aa, H. influenzae strain 86-028NP
MELQVVGANALTVSETTFGREFNEALIHQVVVAYAAGARQGTRAQKTRAEVSGSGKKPWRQKGTGRARAGDIKSPIWRSGGTTFAAKPQDHSQKVNKKMYRGAIKSILSELVRQDRLVVVEKFELDAPKTKVLVQKLKDLAVEDALIITASLDENLFLAARNLYKVDVRDVQGIDPVSLIAFDKVIVTVDAVKQIEEILA

SEQ ID NO: 3419 - protein, 99 aa, H. influenzae strain 86-028NP
MSQERLLSVLRAPHISEKATNNAEKSNTVVLKVALDANKAEIAAAVAQLFEVKVDSVRTVVVKGKTKRRGNKMGRRSDWKKAYVTLAEGQNLDFVDSAE

SEQ ID NO: 3420 - protein, 273 aa, H. influenzae strain 86-028NP
MAIVKCKPTSAGRRHVVKIVNPELHKGKPYAPLLDTKSKTGGRNNYGRITTRHIGGGHKQHYRLIDFKRNKLDIPAVVERLEYDPNRSANIALVLYKDGERRYILAPKGLSVGDQIQAGINSPIKVGNSLPMRNIPVGSTVHNVELKPGKGGQIARSAGAYVQIIAREGNYVTLRLRSGEMRKVLAECVATIGEVGNSEHMLRVLGKAGANRWRGIRPTVRGTAMNPVDHPHGGGEGRNFGKHPVTPWGVQTKGKKTRHNKRTDKYIVRRRGK

SEQ ID NO: 3421 - protein, 91 aa, H. influenzae strain 86-028NP
MPRSLKKGPFLDLHLLKKVEKAVESGDKKPIKTWSRRSMIIPSMIGLTIAVHNGRQHVPVYVSDEMIGHKLGEFAPTRTYRGHAADKKAKK

SEQ ID NO: 3422 - protein, 110 aa, H. influenzae strain 86-028NP
METIAKHRYARTSAQKARLVADLIRGKKVAQALEILTFTNKKAAALVKKVLESAIANAEHNDGADIDDLKVAKIFVDEGPSMKRVMPRAKGRADRILKRTSHITVVVSDR

SEQ ID NO: 3423 - protein, 235 aa, H. influenzae strain 86-028NP
MGQKVHPHGIRLGIVKPWSSTWFANTQDFADNLEGDFKVRKFLNKELANASVSRITIERPAKSIRVTIHTARPGIVIGKKGEDVEKLRNAVSKIAGVPAQINIAEVKKPELDAKLVADSIASQLERRVMFRRAMKRAVQSAMRLGAKGIKVEVSGRLGGAEIARSEWYREGRVPLHTLRADIDYNTAEAHTTYGVIGVKVWIFKGEILGGMAAVAQSEQQPADKPKKAPRGKGRK

SEQ ID NO: 3424 - protein, 136 aa, H. influenzae strain 86-028NP
MLQPKRTKFRKVHKGRNRGIASGTEVSFGTYGLKAVGRCRLTARQIEAARRAMSRAVKRQGKIWIRVFPDKPITEKPLEVRMGKGKGNVEYWVALIQPGKVLYEMDGVSEEVARNAFALAAAKLPVKTTFVTKTVM

SEQ ID NO: 3425 - protein, 63 aa, H. influenzae strain 86-028NP
MKAQDLRTKSVEELNAELVNLLGEQFKLRMQTATGQLQQTHQAKQVRRDIARVKTVLTEKAGE

SEQ ID NO: 3426 - protein, 85 aa, H. influenzae strain 86-028NP
MTDKIRSVQGKVVSDKMEKSFVVAIERKVKHPLYGKFIRRTTKLHVHDENNEAKVGDTVEIRECRPLSKTKSWTLVRVVEKAVIA

SEQ ID NO: 3427 - protein, 207 aa, H. influenzae strain 86-028NP
MKYILIHDLPYQEEEIGITEFYDENDLDTEADIYDRETFRILLGEYVTGLYLLDDTFIEPVLDNINIPNNVYSTNIFAIHHVAKHILGIKDLDKRLKSGDIELVRELGEVTIGGKEKYFYSFATKYCSHHNPIAFPIYDSYVEQDLLYFNKVDKFSAFKRKDLKNYRKFKEILIDFQRFYKLERFNLKELDLYLWLLGKEIFPKSEN

SEQ ID NO: 3428 - protein, 123 aa, H. influenzae strain 86-028NP
MIQEQTMLDVADNSGARSVMCIKVLGGSHRRYAAIGDIIKITVKEAIPRGKVKKGDVLKAVVVRTKKGVRRPDGSVIRFDGNACVILNNNTEQPIGTRIFGPVTRELRSEKFMKIISLAPEVL

SEQ ID NO: 3429 - protein, 103 aa, H. influenzae strain 86-028NP
MAAKIRQNDEVIVLTGKDKGKRGKVTKVLPNGKVFVEGINIITKHEKPVPALGKAGGLVKKEAAIDASNVAIFNPKTNKADRVGFRFEDGKKVRFFKSNNEII

SEQ ID NO: 3430 - protein, 179 aa, H. influenzae strain 86-028NP
MAKLHDYYRDQVVSELKNKFGYKSVMQVPRIEKITLNMGVGEALTDKKLLDNAVADLAAISGQKPLVTKARKSVAGFKIRQGYPIGCKVTLRGERMWEFFERLITIAVPRIRDFRGLSAKSFDGRGNYSMGVREQIIFPEIDYDKVDRVRGLDITITTTAKNDEEGQALLAAFNFPFRK

SEQ ID NO: 3431 - protein, 101 aa, H. influenzae strain 86-028NP
MAKQSMKARDVKRVKLAEKFYAKRVELKKIISDVNASDEDRWDAVLKLQTLPRDSSPSRQRNRCRQTGRPHGVLRKFGLSRIKVREAAMRGEIPGLKKASW

SEQ ID NO: 3432 - protein, 130 aa, H. influenzae strain 86-028NP
MSMQDPIADMLTRIRNGQAANKVAINMPSSKLKVAIANVLAAEGYIESVKVLEGAKPELEITLKYFQGKPVVESIQRVSRPGLRIYKRKDELPKVMGGLGVAVISTSKGVMTDRAARQAGLGGEIICYVA

SEQ ID NO: 3433 - protein, 177 aa, H. influenzae strain 86-028NP
MSRVAKAPVNIPAGVEVKLDGQLLTVKGKNGELSRKIHESVEVKQDNGQFTFTPREGFVEANAQSGTARALVNAMVIGVTEGFTKKLVLVGVGYRAQLKGNAIALSLGYSHPVEHTLPVGITAECPSQTEIVLKGADKQLIGQVAADIRAYRRPEPYKGKGVRYADEVVRIKEAKKK

SEQ ID NO: 3434 - protein, 117 aa, H. influenzae strain 86-028NP
MDKKSARIRRAARARHMMREQGVTRLVIHRTPRHIYAQVIAPNGSEVLAAASTVEKAIREQVKYTGNKDAAAAVGKAVAERALAKGVQAVAFDRSGFKYHGRVQTLADAAREAGLQF

SEQ ID NO: 3435 - protein, 166 aa, H. influenzae strain 86-028NP
MSNIEKQVGELQEKLIAVNRVSKTVKGGRIMSFTALTVVGDGNGRVGFGYGKAREVPAAIQKAMEKARRNMINVALNEGTLQHPVKGVHTGSRVFMQPASEGTGIIAGGAMRAVLEVAGVRNVLSKAYGSTNPINVVRATIDALANMKSPEMVAAKRGKTVDEILG

SEQ ID NO: 3436 - protein, 59 aa, H. influenzae strain 86-028NP
MAKTIKVTQVRSSIARLPKHKATLRGLGLRHMHHTVELIDTPAVRGMINQVSYMVKVEE

SEQ ID NO: 3437 - protein, 144 aa, H. influenzae strain 86-028NP
MRLNTLSPAEGAKHSAKRLGRGIGSGLGKTGGRGHKGQKSRTGSGVRRGFEGGQMPLYRRLPKFGFTSMKSAVTAEVRLNELTKVEGNVVTLETLKAANILTKDIQFAKVILAGEVKSAVTVRGLRVTKGAKAAIEAAGGSIEE

SEQ ID NO: 3438 - protein, 441 aa, H. influenzae strain 86-028NP
MAKQPGYQARSTNSGKGELKSRLLFVLGALIVYRIGSFIPVPGIDATVLAQLVEQQKGTIIDMFNMFSGGALSRASILALGIMPYISASIVIQLLATVSPALAELKKEGAAGQRKISKYTRYATVVFATIQAVAISTGLPNMLSGLVPNVGFSFYFTSVVSLVTGTMFLMWLGEQITERGIGNGISILVFGGIVAGLPSAILQTIEQARQGQMHPLVLLLIAAIVFAVTYFVVFVERGQRRIRVEYAKRQQGRQILGGHSTHLPLKVNMANVMPAIFASSIILFPATLTQWFGQNDKFEWLNNLSMLLNPGQPLYLLVYAVAIIFFSFFYTAMQYNPRDTADNLKKSGAFIPGIRPGEQTSRYIDKVMTRLTLIGGLYVTFVCLVPYIMTSAWDVKFYFGGTSLLIVVVVIMDFIVQVQSHLMSSQYESALKKANLKGFGQ

SEQ ID NO: 3439 - protein, 118 aa, H. influenzae strain 86-028NP
VARIAGINIPDHKHAVIALTAIYGIGKTRSQAICAAAGIAEDVKIRELSEEQIDKLRDEVGKFTVEGDLRREVTLNIKRLLDLGCYRGLRHRRSLPVRGQRTKTNARTRKGPRKPIKK

SEQ ID NO: 3440 - protein, 129 aa, H. influenzae strain 86-028NP
MAKTPVRARKRVKKQVVDGVAHIHASFNNTIVTITDRQGNALAWATAGGSGFRGSRKSTPFAAQVAAERCAEIVKEFGLKNLEVMVKGPGPGRESTIRALNAAGFRITNITDVTPIPHNGCRPPKKRRV

SEQ ID NO: 3441 - protein, 206 aa, H. influenzae strain 86-028NP
MARYLGPKLKLSRREGTDLFLKSGVRAIDSKCKIDTAPGQHGARKPRLSDYGSQLREKQKVRRIYGILERQFRNYYKEANRLKGNTGENLLVLLEGRLDNVVYRMGFAATRAEARQLVSHKAIVVNGRVVNIPSFQVSVNDVVAIREKSKKQARIKASLELAEQREKPTWLEVDSAKMEGVFKRVPERSDLSADINEHLIVELYSK

SEQ ID NO: 3442 - protein, 328 aa, H. influenzae strain 86-028NP
MQGSVTEFLKPRLVDIEQISSTHAKVILEPLERGFGHTLGNALRRILLSSMPGCAVTEVEIDGVLHEYSSKEGVQEDILEVLLNLKGLAVKVQNKDDVILTLNKSGIGPVVAADITHDGDVEIVNPDHVICHLTDENASISMRIRVQRGRGYVPASSRTHTQEERPIGRLLVDACYSPVERIAYNVEAARVEQRTDLDKLVIELETNGALEPEEAIRRAATILAEQLDAFVDLRDVRQPEIKEEKPEFDPILLRPVDDLELTVRSANCLKAETIHYIGDLVQRTEVELLKTPNLGKKSLTEIKDVLASRGLSLGMRLENWPPASIAED

SEQ ID NO: 3443 - protein, 128 aa, H. influenzae strain 86-028NP
MRHRKSGRQLNRNSSHRQAMFRNLASALVSHEIIKTTLPKAKELRRVVEPLITLAKVDSVANRRLAFARTRNVETVAKLFNELGPRFAQRAGGYTRILKCGFRAGDNAPMAYIELVDRPEVAEATTEE

SEQ ID NO: 3444 - protein, 198 aa, H. influenzae strain 86-028NP
MFTLSYYLPQNLNKCIISESKTLEKNSLIYAQGEKPKEFYFLKQGLVGLYHSLENGKETLTRLYHANEYFGFRTIFSETSYHCSAKVLMEADIVRIFPGNHANFIANNPDFSCYLMKQLSNELYDAEHRISNTAYKRSYERIIDAIENLTESYPDYPWTYREVAEFCGCETETAIRISRELKKQGILDKNTRHLRICS

SEQ ID NO: 3445 - protein, 269 aa, H. influenzae strain 86-028NP
MAFSTIFILLICGICTNMVSAIFGIGGGVLMVPILRTLFPALPIQVISATSLTIVMCTALINLLFFHKQKIKIDYINMILWSIAMVIGVQIGFELSFYFSTAIISLIFTVSLSALAIKTFLNRSRIQIEVFNMSPIERAKGSISFCGGGLIAGITGIGGGSILAPLVGQLKGVKTQQIAVYTNYMMIIGGIGNLYGYLTRAFPYDISLSGQLGYVNFLVVGVVTLGSFGMSFFSMKLRGLMNPVLTRKLLAIILFCIAAYMCILEFVFH

SEQ ID NO: 3446 - protein, 397 aa, H. influenzae strain 86-028NP
MQKQNIVILGSTGSIGKSTLSVIENNPQKYHAFALVGGKNVEAMFEQCIKFRPHFAALDDVNAAKILREKLIAHHIPTKVLAGRRAICELAAHPDADQIMASIVGAAGLLPTLSAVKAGKRVLLANKESLVTCGQLFIDAVKNYGSKLLPVDSEHNAIFQSLPPEAQEKIGFCPLSELGVSKIILTGSGGPFRYTPLEQFTNITPEQAVAHPNWSMGKKISVDSATMMNKGLEYIEARWLFNASAEEMEVIIHPQSIIHSMVRYVDGSVIAQMGNPDMRTPIAETMAYPHRTFAGVEPLDFFKIKELTFIEPDFNRYPNLKLAIDAFAAGQYATTAMNAANEIAVQAFLDRQISFMDIAKINSKTIERISPYTIQNIDDVLEIDAQAREIAKTLIRE

SEQ ID NO: 3447 - protein, 185 aa, H. influenzae strain 86-028NP
MLNQIKKDAQDRMEKSLEALKGHISKIRTGRAQPSLLDAIQVEYYGAATPLRQLANVVAEDARTLAVTVFDRSLISAVEKAILTSDLGLNPSSAGTTIRVPLPPLTEERRRDLIKIVKGEGEQGKVAIRNVRRDANDKIKALLKDKEISENEQHKAEEEIQKITDIYIKKVDEVLADKEKELMDF

SEQ ID NO: 3448 - protein, 538 aa, H. influenzae strain 86-028NP
MTDLNKVVKELEALGIYDVKEVVYNPSYEQLFEEETKPGLEGFEKGTLTTTGAVAVDTGIFTGRSPKDKYIVLDEKTKDTVWWTSETAKNDNKPMNQATWQSLKDLVTNQLSRKRLFVVDGFCGASEHDRIAVRIVTEVAWQAHFVKNMFIRPTEEQLKNFEPDFVVMNGSKVTNPNWKEQGLNSENFVAFNLTERIQLIGGTWYGGEMKKGMFSMMNYFLPLKGVGAMHCSANVGKDGDVAIFFGLSGTGKTTLSTDPKRELIGDDEHGWDDVGIFNFEGGCYAKTIHLSEENEPDIYHAIRRDALLENVVVRSDGSVDFDDGSKTENTRVSYPIYHIDNIVKPVSRAGHATKVIFLTADAFGVLPPVSKLTPEQTKYYFLSGFTAKLAGTERGITEPTPTFSACFGAAFLTLHPTQYAEVLVKRMQAAGAEAYLVNTGWNGTGKRISIKDTRGIIDAILDGSIEKAEMGELPIFNLAIPKALPGVDSAILDPRDTYADKAQWQSKAEDLAGRFVKNFVKYATNEEGKALIAAGPKA

SEQ ID NO: 3449 - protein, 293 aa, H. influenzae strain 86-028NP
MTNQQDYTQDNDKLYRYLFQHRAVRGEWVRLNKTFTDTLNTHQYPKAVQDLLGEMMVATNLLTATLKFAGNITVQIQGDGPLRLALVNGNDQQQIRALARVDGNITENMSLHNMIGKGVLVITIAPKEGERYQGVISLDKPTITECLEDYFVRSEQLQTQLIIRTGEYEGKPVAAGMLLQIMPDGSGTPEDFEHLTTLAATVKDEELFGLPAEELLYRLYHEETVNLYPAQDVQFFCGCSAERSSSALLLISDEEIDEILAEHKGSIDMQCECCGTHYFFNKEAIEKLKSTRV

SEQ ID NO: 3450 - protein, 457 aa, H. influenzae strain 86-028NP
MALWGGRFTQAADKRFKDFNDSLRFDYRLAEQDIQGSIGWSKALVKVNVLTVEEQHQLEQALNELLVEVRSNPQAILQDDAEDIHSWVESKLIDKVGNLGKKLHTGRSRNDQVAVDIKLWCKQRVVELQESVRNLQRHLVQTAENTQQAVMPGYTHLQRAQPITFAHWCMAYVEMFDRDYSRLTDAYNRMNTCPLGSGALAGTAYAVDRDSLAHDLSFAFATRNSLDSVSDRDHIVELLSIASLSMAHLSRFAEDMIIFNSGEANFVELSDRVTSGSSLMPQKKNPDACELIRGKTGRVIGSLTSMLITLKGLPLAYNKDMQEDKEGIFDALDTWQNCVDMATFVLDELKVNVERTREAALKGYSNATELADYLVSKGVPFRDSHHIVGETVVYAIEKGKGLEDLTIPEFRQFSEVVGDDVYEILSLQSCLDKRCAKGGVSPLRVAEAIAEAKTRFA

SEQ ID NO: 3451 - protein, 295 aa, H. influenzae strain 86-028NP
MKAIIPVAGLGTRMLPATKAIPKEMLTLVDKPLIQYVVNECVAAGIKEIVLVTHSSKNAIENHFDTSFELETMLEKRVKRQLLEEVRSICPKNVTIMHVRQGNAKGLGHAVLCGRPLVGNESFAVMLPDVLLAEFSADQKKENLAAMIQRFNETGASQIMVTPVPQENVSSYGVADCGGIELNGGESAKINSIVEKPSIEDAPSNLAVVGRYVFSAAIWDLLEKTPIGVGDEIQLTDAIDMLIEKETVEAFHMTGETFDCGDKIGYMEAFVEYGIRHEKLGKEFKSFIKNLAKTL

SEQ ID NO: 3452 - protein, 63 aa, H. influenzae strain 86-028NP
MLILTRKVGESVLIGDDISITVLSVRGNQVKLGVEAPKEVSVHREEIYQRIKQTKDEPYLGSS

SEQ ID NO: 3453 - protein, 874 aa, H. influenzae strain 86-028NP
MKTTAEIRQSFLDFFHSKGHQVVESSSLVPENDPTLLFTNAGMNQFKDVFLGMDKRPYSRATTAQRCVRAGGKHNDLENVGYTARHHTFFEMLGNFSFGDYFKQDAINFAWEYLTSPQWLGLPKEKLWVTVYETDDEAYNIWNKDVGVPAERIIRIGDNKGSPYASDNFWAMGDTGPCGPCTEIFYDHGDHIWGGPPGSPEEDGDRYIEIWNVVFMQFNRLADGTMEKLPRPSVDTGMGLERISAVLQHVNSNYEIDIFKTLIAKTAEIVGATDLTNKSLRVIADHIRSCAYLIADGVIPSNEGRGYVLRRIIRRAVRHGHLLGAKESFFYKLVPTLIEVMAEAGKDVKAKQTNVEKLLRLEEEQFARTLERGLSLLDEALSQVKDGILSGEVAFKLYDTYGFPLDLTADVCRERNITIDEQAFDREMEAQRTRAQAASQFGVDYNSVIRVDGETKFEGYTEVESQAKITALFYDGKSVESIEVGQSAVVILENTPFYAESGGQIGDSGYLSTQGVTFNVKDTQKYGQVFGHIGELTQGSLKVGQSVNAIVDAKRRHNTSLNHSATHLLHAALRQILGLHVVQKGSLVSDKALRFDFAQPEAITKEQLSEIETLVNQKIRANFPVQTDIMDIDSAKAKGAMALFGEKYGDKVRVLTMGDFSIELCGGIHAKRTGDIGLFKIITENAVAAGIRRIEAVTGQNAIDWLHNQQRILTQSADLLKSDVNTLVEKIQQLQDKTKKVEKELQGLKEKAAMQAGSDFVKSAVKINGVSVIAQQLDGIETKSLRVMVDDLKNQLGSGVIAFASILDEKVNLVVGVTNDLTAKIKAGELVNLMAQQVGGKGGGRPDMAMAGGSQPENVAQAIKVAQDWLNKNL

SEQ ID NO: 3454 - protein, 141 aa, H. influenzae strain 86-028NP
MYKHVLVAVDLSEESPILLKKAVGIAKRHDAKLSIIHVDVNFSDLYTGLIDVNMSSMQDRISTETQKALLDLAESVDYPISEKLSGSGDLGQVLSDAIEQYDVDLLVTGHHQDFWSKLMSSTRQVMNTIKIDMLVVPLRDE

SEQ ID NO: 3455 - protein, 430 aa, H. influenzae strain 86-028NP
MELTYMAKLPKEEFEERRTRVFAQMQPNSALLLFSEIEKRRNNDCTYPFRQDSYFWYLTGFNEPNAALLLLKTEQVEKAIIFLRPCDPLLETWNGRRLGVERAPQQLNVNEAYSIEEFATVLPKILKNLTALYHVPEIHTWGDTLVSESAVNFSEILDWRPMLSEMRLIKSPNEIRLIQQAGQITALGHIKAMQTTRPNRFEYEIESDILHEFNRHCARFPSYNSIVAGGSNACILHYTENDRPLNDGDLVLIDAGCEFAMYAGDITRTFPVNGKFSPPQREIYELVLKAQKRAIELLVPGNSIKQANDEVIRIKTQGLVDLGILKGDVDTLIEQQAYRQFYMHGLGHWLGLDVHDVGSYGQDKQRILEIGMVITVEPGIYISEDADVPEQYKGIGVRIEDNLLMTEYGNKILTAAVPKEIADIENLMNF

SEQ ID NO: 3456 - protein, 182 aa, H. influenzae strain 86-028NP
MLISHSDLNQQLKSAGIGFNATELHGFLSGLLCGGLKDQSWLPLLYQFSNDNHAYPTALVQPVTELYEKISQTLSDVEGFTFGLGLTEDENVFAQADSLSDWANQFLLGLGLAQPELAKEKGEIGEAVDDLQDICQLGYNEDDNEEELAEALEEIIEYVRTIAMLFYSHFNEGEIESKPVLH

SEQ ID NO: 3457 - protein, 341 aa, H. influenzae strain 86-028NP
MMLEQTTFNAPDGAPYQLITLQNENGMRVQFLDWGATWLSCKVPVNDTLREVLLGCKVENYPTHQSYLGASVGRYANRIANAQFELNGELIKLSSNQGKHQLHGGEGFDKRRWKIQECGENFVCFSLQSEHGDQGFPGNVDVSVTYTLTDDNSVKIEYAGICDKDTALNLTNHAYFNLENAAQGSDVREHTLRLNADFYLPVDNEGIPNSPLKHVVNTSFDFRIAKPIKQDFLQGDQQATKGYDHSFIVNKAWQKPCVLLTSPTGDLSLEVRTSQAALQVYTGNYLAGTPTRNGELYADFSGIALETQCLPDTPNHPEWQNYGGIQKASEQYYQWTEFKFK

SEQ ID NO: 3458 - protein, 398 aa, H. influenzae strain 86-028NP
VVQIEYRFNIKDRNMTPIQNAQQIFNRQHKNLPEITVYAPGRVNIIGEHTDYNDGFVMPCAINFGTAVSGTKRDDHIWNVYAADLDETDEFSLNVEIPKSEHKWANYVRGVVKFIQERYPHFQQGANLVISGNVPLSSGLSSSAALEVAVGKFCQQLGDLPLSHTDIALNGQKAENQFVGANCGNMDQLISALGQENHLLMIDCRSLETIPTPVPQDVAVIIVNSNVPHDLVTGEYNTRRQQCEEAVKFFGAKALRDVSVEQFQKREAELTALSPLAAKRARHVVTENQRVLDAVEALKNNDLTCLGKLMEASHDSMRDDFEITVPQIDYLVELAQLVIGKSGGARMTGGGFGGCIVALTPHDKVDAVRKIIADNYEKTTGLKETFYVCTASQGVRVI

SEQ ID NO: 3459 - protein, 349 aa, H. influenzae strain 86-028NP
MTALFEPTEHPHRRYNPLIDQWVLVSPHRAKRPWQGQQEKVNEEQKPSYDPTCYLCPSNKRITGELNPDYRKPYVFKNDFSALLEDTPAPEKSSDPLFQSSQARGESRVICFSPDHSKTLPLLTALEIEEVIKVWQEQLRELGAKYQWVQIFENKGAAMGCSNPHPHGQIWANSFLPNEVAREDRTQRDYLLKHGSVMLVDYVKRELALKERIVVETEHWVALVPYWAIWPFETLLLPKTHVKRLTELSDEQSKDLAVILKKLTTKYDNLFETSFPYSMGFHAAPFNGEDNEHWQLHAHFYPPLLRSATVRKFMVGYEMLGENQRDLTAEQAAERLRALSEVHYKERTK

SEQ ID NO: 3460 - protein, 332 aa, H. influenzae strain 86-028NP
MSTIRDVAKLANVSVATVSRVLNHSLSVSENTRLAVEQAIAQLAYQPNANAQALAVQNTDTIGVVVTDVTDAFFAILVKAVDKVAEAHQKTILIGIGYHHAEKEREAINTLLRKRCSSLVVHSKALSDDELSHYLNTVQGMVIINRVIKGYEHRCVSLDNQKGTYLATEMLIRYGHQHIAYIGSNHAIFDEVERRNGYLAALKDHNYPIIEQAITLNSPDFEGGEKAMIDLLSYNKNLTAVVAYNDSMAAGAISVLNENNISVPSQFSIIGFDDMPIARYLIPKLTTIRYPIDLMATYAAKLALSLTDEKIITPPVVQFNPTLVRRFSVESR

SEQ ID NO: 3461 - protein, 349 aa, H. influenzae strain 86-028NP
MMYTTLSIHINLPNRSVIMKKTAVLSTVAFAIALGSASASFAADNRIGVTIYKYDDNFMSLMRKEIDKEAKVVGGIKLLMNDSQNAQSIQNDQVDILLSKGVKALAINLVDPAAAPTIIGKAKSDNIPVVFFNKDPGAKAIGSYEQAYYVGTDPKESGLIQGDLIAKQWKANPALDLNKDGKIQFVLLKGEPGHPDAEVRTKYVVEELNAKGIQTEQLFIDTGMWDAAMAKDKVDAWLSSSKANDIEVIISNNDGMALGALEATKAHGKKLPIFGVDALPEALQLISKGELAGTVLNDSVNQGKAVVQLSNNLAQGKSATEGTKWELKDRVVRIPYVGVDKDNLGDFLK

SEQ ID NO: 3462 - protein, 506 aa, H. influenzae strain 86-028NP
MTAQTQCQDSQVLLTMTNVCKSFPGVKALDNANLTVRSHSVHALMGENGAGKSTLLKCLFGIYAKDEGEILFLGEPVNFKTSKEALENGISMVHQELNLVRQTSVMDNLWLGRYPLKGPFVDHAKMYRDTKAIFDELDIDVDPKEKVAKLSVSQMQMIEIAKAFSYNAKIVIMDEPTSSLSEKEVEHLFKIIDKLKQRGCGIIYISHKMDEIFKICDEITILRDGKWINTVNVKESTMEQIVGMMVGRELTQRFPEKTNVPKEVILQVENLTAKNQPSIQDVSFELRKGEILGIAGLVGAKRTDIVEAIFGVRELIEGTIKLHGKTVKNHTALEAINNGFALVTEERRSTGIYSNLSIEFNSLISNMKSYLTPWKLLSTKKMKSDTQWVIDSMNVKTPSHRTTIGSLSGGNQQKVIIGRWLLTQPEILMLDEPTRGIDIGAKFEIYQLIQELAKKDKGIIMISSEMPELLGVTDRILVMSNGKLAGIVESAKTSQEEILQLAAKYL

SEQ ID NO: 3463 - protein, 336 aa, H. influenzae strain 86-028NP
MSALEKNKSFDLLKQNAIYFVLLILLGIIIAQDPTFLNLVNFSNILTQSSVRLIIALGVAGLLITQGTDLSAGRQVGLSAVISATMLQSMENINRVFPEMGQIPIPVVILAVCAIGAVIGLVNGLVIAYLNVTPFIATMGTMIIIYGFNSLYYDAVGGSPIAGFSENFSTFAQGFFRVGSFKLSYITIYAAIAALLVWIMWNKTRFGKNVFAIGGNPEAAKVSGVNVARNLVAIYMIAGMFYAFGGMLEAGRIGSATNNLGFMYELDAIAACVVGGVSFAGGVGTVIGVITGVIIFTVINYGLTYIGVNPYWQYIIKGSIIILAVAIDSLKYAKKK

SEQ ID NO: 3464 - protein, 244 aa, H. influenzae strain 86-028NP
MLINFTQVLQDSWNFFRNQKKIMLQFVAILFIVQSASALLSFSVNDENKNDVLNLANTDITSFIFSVAITQILTSFIAAWGLTSIHKISLQNYRTLGETFSLTLRRFAGVIVLDLLMVAPMLLGLGEAFAALLTKKSPSIMSLIAMLVGVWFFVRLNLTVVHYLSTQEALSQTIRKIWMRGNTRKGVLFIYTLLVYFLVPILIFQLSAFSNNAIFDMVIGIFTALLNIFMLVVTYRFYSLFMKD

SEQ ID NO: 3465 - protein, 185 aa, H. influenzae strain 86-028NP; identical to SEQ ID NO: 638

SEQ ID NO: 3466 - protein, 154 aa, H. influenzae strain 86-028NP
MSANFTDKNGRQSKGVLLLRTLAMPSDTNANGDIFGGWIMSQMDMGGAILAKEIAHGRVVTVAVESMNFIKPISVGDVVCCYGECLKVGRSSIKIKVEVWVKKVASEPIGERYCVTDAVFTFVAVDNNGRSRTIPRENNQELEKALALISEQPL

SEQ ID NO: 3467 - protein, 98 aa, H. influenzae strain 86-028NP
MYYVIFAQDIPNTLEKRLAVREQHLARLKQLQAENRLLTAGPNPAIDDENPSEAGFTGSTVIAQFENLQAAKDWAAQDPYVEAGVYADVIVKPFKKVF

SEQ ID NO: 3468 - protein, 593 aa, H. influenzae strain 86-028NP
MKKVALISLCIFTALSAFADSPNTATASINLEQEKQNWASIQHQDYLKRLKQREVFLQVEGLLKSAVKKQQFSEAIQNITKTLIDSLQGYPLQYDLLARFWETKIAFLQNDDIQGKQQAINEVNALVQQNYPFVTPAFQALLQKLSTLNEQQTSATSDNAKENNRVQKEQNQVENPKQLAEIVRKSDPNTLDKTVLIDAFPRYLKTLPEQMNNLSFESYQKWANTWQLSEDEIKQWKIAFLNRFFDNENTDFQKWRDEQIRQLQTDNLTERRLRMAIWQKTELTSWLNLLSAESKSKQEWRYWEAKQDILKNTKKLTALSKERGFYPMLAATQLKQAYQLNVPIASSFTQAEQLPFKQVFAMITELRELGRNGLAKQRWRILLDNVDFTTQLKLSEYAKNQQWFELAVDASIVAKAWGYLSLRLPNAYSEYFNAALQNLNISKTFAMAIARQESAWNPMAQSSANARGLMQLLPSTAKLTAENNQLPYQGEQDLFKPLNNILLGTAHLNELNGKYPNNRILIAAAYNAGANRVEKWLSRASGKLALDEFVASIPFYETRGYVQNVVAYDFYYQILQNKENPQIFSQEELNRLY

SEQ ID NO: 3469 - protein, 101 aa, H. influenzae strain 86-028NP
MYISRNLEQWNAFLQMLKIAFEENKAQEFLTLLLTADERDAVGLRLQIVSQLIDKNMPQREIQQNLNTSAATITRGSNMIKTMDPDFMQWMKQHLDLIEKN

SEQ ID NO: 3470 - protein, 194 aa, H. influenzae strain 86-028NP
MVQQKIANLLQGDFRYQIQYNWVSLENISPNIQLAVISSEDQRFFEHLGFDFEAIQRAIRYNEKSNKGIRGASTISQQTAKNLMLWHGQNWLRKGLEVPATMLLELTWSKKRILEVYLNIAEFGNGIFGVEAASRYYFKKSAKNLSQNEAALLAAVLPNPIIYKVNKPSLLVRKKQTWILRQMGNLGTEYLSDL

SEQ ID NO: 3471 - protein, 114 aa, H. influenzae strain 86-028NP
MVDQNPKRSGEPPVWLMFGAGGTVSAIFLPVVILIIGLLLPFGLVDAHNLITFAYSWIGKLVILVLTIFPMWCGLHRIHHGMHDLKVHVPAGGFIFYGLATIYTVWVLFAVINL

SEQ ID NO: 3472 - protein, 136 aa, H. influenzae strain 86-028NP
MSVTVSKRKKYVRPMTATWWQKLDFYKAYMLREATSVFAVWFCIVLLYGVLCLASNPMPGLGILSFIEFLRNPIVVFLNIITLIATLYHTVTYFLMTPKVMNIIVKNERLPHTVVRNALWAVTTLVSVIALVLVYI

SEQ ID NO: 3473 - protein, 256 aa, H. influenzae strain 86-028NP
MANSPVMNVEVLRYNPEIDQEPHLSTYQVPYDNQTSLLDALGYIKDKLEPSLSYRWSCRMAICGSCGMMVNNKPKLACKTFLRDYSGHMRIEPLANFPIERDLVVDLSHFIESLEAIKPYIIGNEAPALDGKPHPSKELQVSRTKQTPAQLEKYRQFSMCINCGLCYAACPQFGLNPEFLGPAAITMAHRYNLDNRDHGKAKRMSLLNGKNGVWSCTFVGYCSEVCPKHVDPASAINQGKVESAKDYVISMLKPKG

SEQ ID NO: 3474 - protein, 599 aa, H. influenzae strain 86-028NP
VQTVNVDIAIVGAGGGGLRAAIAAAEANPNLKIALVSKVYPMRSHTVAAEGGAAAVIKEEDSYDKHFQDTVAGGDWLCEQDVVEYFVQHSPVEMTQLERWGCPWSRKADGDVNVRRFGGMKIERTWFAADKTGFHLLHTLFQTSIQYPQIQRFDEHFVLDILVDDDHARGMVAMNMMEGSLVQINANAVVIATGGGCRAFKFNTNGGIVTGDGLSMAYRHGVPLRDMEFVQYHPTGLPNTGILMTEGCRGEGGILVNKDGYRYLQDYGLGPETPIGKPQNKYMELGPRDKVSQAFWQEWKKGNTLKTAKGVDVVHLDLRHLGEKYLHERLPFICELASAYEGVNPVNEPIPVRPVVHYTMGGIEVDFNSETRIKGLFAVGECASSGLHGANRLGSNSLAELVVLGRVAGEYAAQRAVEAQSVNQSAVDAQAKDVVARLEALHKQEGNESWSEIRDEMGTVMEEGCGIYRDQASMQKAVDKIAELKERYKRIRVSDNSSVFNTDVLYTVELGYILDVAQSIANSAIERKESRGAHQRLDYTERDDVNYLKHTLAFYNENGAPRIEYSPVKITKSQPAKRVYGAEAEAQEAAAKAKEQANG

SEQ ID NO: 3475 - protein, 333 aa, H. influenzae strain 86-028NP
MCKIFKTGLKMTALNHWQPSADIKNLLKRAKIIAEIRQFFTERGLLEVETPVLSEFGVTDLHLSTFSTEFLAPFGEQSKTLWLSTSPEYHMKRLLAAGSGPIFQISKVFRNEEAGNRHNPEFTMLEWYRPHFHMHRLINEVDDLLQQILDCPPAESLSYQFVFQEYVGLDPLSAERSELIEAARKHNFMAEDNEDRDTLLQFLFSEVVEPQIGKERPIAVYHFPSTQAALAQVSPEDQRVAERFEFYYKGLELANGFHELADAQEQRHRFELDNQQRQKCELPTREIDERFLAALEAGMPDASGVALGIDRLMMIALDCEKINDVISFAVDNA

SEQ ID NO: 3476 - protein, 227 aa, H. influenzae strain 86-028NP
MSKLLLVDDDIELTELLSTLLELEGFDVETANNGLEALQKLNESYKLVLLDVMMPKLNGIETLKEIRKVSNVPVMMLTARGEDIDRVLGLELGADDCLPKPFNDRELIARIKAILRRSVSPSNNTANVEILSFDGITLHFSHGIATYNEENLNLTDYEFKILCLLLKSKGNVVSREELSLEVMEKPLTPFDRSLDMHISNLRRKLPERKNKPSWFKTLRGKGYALVT

SEQ ID NO: 3477 - protein, 137 aa, H. influenzae strain 86-028NP
MQVKTLLGATFLALSLASCSTVEKVVYRIDVPQGNYLEATTVAQVKEGMTSQQVQYLLGTPILIDPYNNYTWYYVFLQQRAYETPVQHTFTVKFDQRGIVTETHLDKPLPQVSQQGENNTIIETGEKPKSSWWKFWK

SEQ ID NO: 3478 - protein, 341 aa, H. influenzae strain 86-028NP
VTKMSITVNQIVLHQLVKNVDGDSIKMESVLRDELLSITPEVEQMMLQLHQGYQNKAKAFGVFQEKSIFAQHLNRLLEQEIEFLGFSQYSTKLLADELGKYNFAESGTLILCQYNFLATDYLFIALLDSRHSMLVDEHLDIRRTEYLDITQFDIAARINLTDLQVNANSNRYLTFIKGRVGRKISDFFMDFLGAEEGLNPQVQNQCLLQAVSDYCDQGELNKEQTQAVKKQVFEYCKGQLSNGNNIELRELSDSLPTLNEQPFVVFTEEQNYGLEESIPPIRSTLKSLTKFSGSGKGVTLSFDAELLNTRIQWDPMTDTLTIKGLPPNLKDQLQKALQSEN

SEQ ID NO: 3479 - protein, 72 aa, H. influenzae strain 86-028NP
MAQHSKYSDAQLSAIVNDMIAVLEKHKAPVDLSLIALGNMASNLLTTSVPQTQREALAQAFSNSLINAVKTR

SEQ ID NO: 3480 - protein, 585 aa, H. influenzae strain 86-028NP; identical to SEQ ID NO: 771

SEQ ID NO: 3481 - protein, 330 aa, H. influenzae strain 86-028NP
MKSHVRSFKTYIRDEIIKKGGWVNAHAHADRAFTMTPEKIGIYHSSNLQQKWDLVDEVKRTSSVDDYYARFCQSIELMISQGVTAFGTFVDIDPICEDRAIIAAHKAREVYKHDIILKFANQTLKGVIEPTARKWFDIGAEMVDMIGGLPYRDELDYGRGLEAMDILLDKAKSLGIMCHVHVDQFNNPSEKETEQLCDKTIEHGMEGRVVGIHGISIGSHSKEYRYKLYEKMRKAKMMMIACPMAWIDSNRKEDLMPFHNALTPADEMIPEGITVALGTDNICDYMVPLCEGDLWQELSLLAAGCRFPHLDEMVNIASINGRKVLGLELI

SEQ ID NO: 3482 - protein, 192 aa, H. influenzae strain 86-028NP
MTITISAVILAGGKARRMGGQDKGLQILGKQSLIEHVINRLQPQIHQISINTNRNQTEYAKFGFPVFSDELPDFQGPLSGMLTALEKTKSDFILFTPCDTPFFPMNLLDKLKSAVKNDRTLIAYACDEEREHPVFCLMSVQLKEKLRHYLASGERRLLQFMKENGGISVKFTQEEGNFENFNTLDDLKKTVI

SEQ ID NO: 3483 - protein, 88 aa, H. influenzae strain 86-028NP
MKCKRLNEVLELLQFYWSKDSDLSLMEILQKIANESGFQKPLNELTDEVIIYQLKMDGTDKYEPIPGLKKDYEEDFKTALLRARGIIK

SEQ ID NO: 3484 - protein, 205 aa, H. influenzae strain 86-028NP
MKKVLLALGLGVSTLMSVNSFAADLQEGKQYVQVSQQASQQKEVIEFFSFYCPHCYAFEMEYKIPQQVVDALPKDVKFKQYHVNFLGHQSENLTRAWALAMALGAESKVKSPLFEAAQKDALKSMDDIRAIFLSNGITAEQFDGGINSFAVNGLVNKQVNAAEQFKVRGVPDFYVNGKFRVNPEGLNYDDFVKDYVQTVKGLLQK

SEQ ID NO: 3485 - protein, 111 aa, H. influenzae strain 86-028NP
MAASFSVTRRFFDDKNYPRGFSRHGDYTIKESQVLEQYGQAFKALDLGEREPATKEEKDFVAFCRGERAAETFFEKTWNKYRTRINTKKRVYTLSSDVSEAASGGEDYSGE

SEQ ID NO: 3486 - protein, 363 aa, H. influenzae strain 86-028NP
MQLPISQYNELLQKKLEKLTALLHPFNAPDIQVFDSPTSHYRMRAEFRIWHEQDDFYHIMFDQATLQRYRVDEFPIASMLINRMMQTLLPLLKQQEVLHKKLFQIDYLSTLSNKIIVSLLYHKTLTEEWESAAKNLKDLLEKQDFDVQIIGRASKQKICFEQDYVDEVLPVNGRNYVYRQVENSFTQPNATVNCKMLEWAIDCTQNSEGDLLELYCGNGNFSIALAQNFRKVLATEIAKPSVAAAQFNIAENKVDNLQIIRMSAEEFTQAMNGVRAFNRLKGIDLKSYECNTIFVDPPRAGLDPDTVKLVQNYDRILYISCNPHTLCDNLVELSKTHRIEKAALFDQFPYTDHMESGLWLIRK

SEQ ID NO: 3487 - protein, 188 aa, H. influenzae strain 86-028NP
MAHRRKFGGGRGEAVAKAVGIKGSALPTVIDATAGLGRDAFVLAAIGCQVRLVERHPVVFLLLQDGLNRAYQDEEIGEMLQQNLHLLNVQHINELDPNSDYADVVYLDPMYPHKQKSALVKKEMRVFQHLVGADLDADELLLPALQLAKKRVVVKRPDYAEFLCGKQPHFSRETKNHRFDIYMGASQC

SEQ ID NO: 3488 - protein, 144 aa, H. influenzae strain 86-028NP
MLRESAVVISYENGIAKVKCQSQSACGQCAAKNSCGTSSLSELNGKRGEHIFNVETLMPLREGQIVEIGLEEKSMLLSALLMYVVPLLTLLIVTMLSDYISDNEILRAILIFGLTALSFIFVKSYSRKLGQQTEFQPVLLRILS

SEQ ID NO: 3489 - protein, 178 aa, H. influenzae strain 86-028NP
VIFKVIFMNNQIPLLGITGYSGSGKTTLLEKLIPELIARHIRVSVIKHSHHNMQVDKEGKDSWRMKEAGSSQVIVANDERWAIMTETPKPVSLDYLAQQFDRTLTDLVLVEGFKQEPIPKILLHRQEMTKPLPEIDEYVLAVATNYSLEIDRTLLDINRIPQIADFIENWLHHFHGAR

SEQ ID NO: 3490 - protein, 463 aa, H. influenzae strain 86-028NP
MTTESNAYRGLAWVAAMALFMQSLDATILNTALPAISSDLHKPAFEMQMAIIAYSLAVALFIPLTAWAAAKFGTLTVFRGAVFTFILGSVACAAASNLESLILARVIQGIGGAFMMPVARLAIIQAVPKQQLVNAWNLMATAGLIGPILGPILGGWLVIHASWHWIFLINIPIGVLGILASGSVMNNIKGKAEKLDWTGFLLFALGLVGITLGLDLLGESQHNSSVTYSILVVGILLLVTYCGYAKNNENAILPLSLFRTRTFRLGIIANIFIRLSASGVPFLLPLMFQLSFGYSAEMSGWLLAPIALISVMLKILIGRILNRWGYKTTLISSALLMAGSVISMAWLDKQSSLTWIICNLMWYGACMSIIFTSINTLAVGDLSKQQSGTGSTVLSIVQQVGIGFGIAVSSIILNLYRHFFNASDCLQQAFSYTFLTSSLFVIALVWSLMKLHKNDGDHLRKMP

SEQ ID NO: 3491 - protein, 549 aa, H. influenzae strain 86-028NP
MLMKLKATLTLAAATLVLAACDQSSSANKSTAQTEAKSSSNNTFVYCTAKAPLGFSPALIIEGTSYNASSQQVYNRLVEFKKGSTDIEPALAESWEISDDGLSYTFHLRKGVKFHTTKEFTPTRDFNADDVVFSFQRQLDPNHPYHNVSKGTYPYFKAMKFPELLKSVEKVDDNTIRITLNKTDATFLASLGMDFISIYSAEYADSMLKAGKPETLDSRPVGTGPFVFVDYKTDQAIQYVAHENYWKGRTPLDRLVISIVPDATTRYAKLQAGTCDLILFPNVADLAKMKTDPKVQLLEQKGLNVAYIAFNTEKAPFDNVKVRQALNYAVDKKAIIEAVYQGAGISAKNPLPPTIWSYNDEIQDYPYDPEKAKQLLAEAGYPNGFETDFWIQPIIRASNPNPKRMAELIMADWAKIGVKTNPVTYEWADYRKRAKEGELTAGIFGWSGDNGDPDNFLSPLLGSSNIGNSNMARFNNSEFDALLNEAIGLTNKEERAKLYKQAQVIVHNQAPWIPVAHSVGFAPLSPRVKGYVQSPFGYDAFYGVSVDGK

SEQ ID NO: 3492 - protein, 253 aa, H. influenzae strain 86-028NP
MDFNRIITHMNDHHQDDMAALCKKFGGEKEITDVTLVNVDFAGLDFKYNGGKTLRVEFPQQADAGSIKQAIINLCVENKPVANYDRIKAKIDEFRQEFKSCVLSTLDKDGLPMASYAPIIFFDGKYYIYISAIAEHYENLKRNPNQVEVMFLEDENKAKSIIVRTRLRYKASARFIPREDPIVEKVLDKLAETMNDVGGIKTIREFTDFDLVELTFGTGRFVRGFGQAYLIDANGEISHIGVKGNPHEKESDK

SEQ ID NO: 3493 - protein, 115 aa, H. influenzae strain 86-028NP
MNLERLNEIEKPLLHIVKHDVVPALGCTEPISLALASATAAKYLGKTPERIEVKVSPNLMKNGLGVAVPGTGMVGLPIAAAMKVLSNTILIELLIISALLHQKVCSISTDRLSKL

SEQ ID NO: 3494 - protein, 930 aa, H. influenzae strain 86-028NP
MAQIATNPLVLVDGSSYLYRAFHAFPSLTNAAGEPTNAMYGVLNMLKRLISQVQPTHIAVVFDAKGKTFRNEMFEQYKSHRPPMPDDLRKQIQPLHDMIRALGIPLLVVEGIEADDVIGTLALQASSLGKKVLISTGDKDMAQLVDDNIMLINTMNNSLLDREGVIEKYGIPPELIIDYLALMGDSADNIPGVAGVGEKTALGLLQGIGSMAEIYANLEKVAELPIRGAKKLGEKLLAEKPNADLSYTLATIKTDVELNVTTDQLLLGESQKDQLIEYFARYEFKRWLNEVMNGADSITQTTEQPVKMNQYQATSQDQSAVENTPKIQIDRTKYETLLTQADLTRWIEKLNTAKLIAVDTETDSLDYMSANLVGISFALENGEAAYLPLQLDYLDAPKTLEKSTALAAIKPILENPDIHKIGQNIKFDESIFARHGIELQGVEFDTMLLSYTLNSTGRHNMDDLAKRYLGHETIAFESIAGKGKNQLTFNQIPLEQATEYAAEDADVTMKLQQALWLKLQQEPTLVELYKTMELPLLHVLSRMERTGVLIDSNALFMQSNEIATRLTALEEQAYELAGQPFNLASTKQLQEILFDKLGLPILQKTPKGAPSTNEEVLEELAYSHELPKILVEHRGLSKLKSTYTDKLPQMVNSQTGRVHTSYHQAVTATGRLSSSDPNLQNIPIRNEEGRRIRQAFIAREGYSIVAADYSQIELRIMAHLSGDQGLINAFSQGKDIHRSTAAEIFGVSLDEVTSEQRRNAKAINFGLIYGMSAFGLSRQLDISRPDAKKYMDLYFQRYPSVQQFMTDIREKAKAQGYVETLFGRRLYLPDINSSNAMRRKGAERVAINAPMQGTAADIIKRAMIKLDEVIYHDPDIEMIMQVHDELVFEVRSEKVEFFREQIKQQMEDASELVVPLIVEVGVGQNWDEAH

SEQ ID NO: 3495 - protein, 100 aa, H. influenzae strain 86-028NP
MSLKLVEILVLGQVLRLNVPIEQEELLRQAARNLDILVSEMKEKTGLIQLDRVLSIVALNLSFELSQEKNKTAKIEEVLRTGIQQLDHSLENIRVTKEPH

SEQ ID NO: 3496 - protein, 187 aa, H. influenzae strain 86-028NP
MNTQKRQQIRAEIRKIRANLTALQQQQAAQSVTQQALNLIEQRQAKNIALYFSFDGEISTKALIQSLWMQNKNVYLPVLHPFTKHYLLFLRYLPDTPMKQNQFGIWEPKLNVQNVLPLNELDILFTPLVAFDKKGNRLGMGGGFYDRTLQNWQNKSFIPVGLAHQCQQVENLPTEHWDVPLFDILVD

SEQ ID NO: 3497 - protein, 856 aa, H. influenzae strain 86-028NP
MNIEKFTTKFQEALSEAQSLAIGKDNQFIEPVHLLTALLNQQGGSIAPILTASGVNVALLRNELKTELNKLPQVIGNGGDVQLSRQLINLLNLCDKFAQQNQDKFISSELFLLAALEERGTISDILKKCGAKKEQISQAIQHIRGGQNVNDQNAEESRQALEKYTIDLTARAESGKLDPVIGRDEEIRRAIQVLQRRTKNNPVLIGEPGVGKTAIVEGLAQRIVNGEVPEGLKNKRVLSLDMGALIAGAKYRGEFEERLKAVLNELSKEEGRVILFIDEIHTMVGAGKTDGAMDAGNLLKPSLARGELHCVGATTLDEYRQYIEKDAALERRFQKVFVDEPSVEDTIAILRGLKERYEIHHHVDITDPAIVAAATLSHRYISDRQLPDKAIDLIDEAASSIRMEIDSKPEPLDRLERRIIQLKLEQQALQKEEDEASRKRLEMLEKELAEKEREYAELEEVWKSEKATLSGSQHIKQELDTAKTELEQARRAGDLAKMSELQYGRIPALEKQLEQAETSEGKEMTLLRYRVTDEEIAEVLSKATGIPVSKMMEGEKEKLLRMEDELHKRVIGQEEAVDAVANAIRRSRAGLSDPNRPIGSFLFLGPTGVGKTELCKTLAKFLFDSEDAMVRIDMSEFMEKHSVSRLVGAPPGYVGYEEGGYLTEAVRRRPYSVILLDEVEKAHADVFNILLQVLDDGRLTDGQGRTVDFRNTVVIMTSNLGSDLIQGNKDESYSEMKALVMSVVSQHFRPEFINRIDETVVFHPLGKENIRAIASIQLERLAKRMETRGYELVFTDALLDFIGEVGYDPIYGARPLKRAIQQEIENSLAQQILSGALLPGKVVTIDYANAEVQARQ

SEQ ID NO: 3498 - protein, 246 aa, H. influenzae strain 86-028NP
MSEQIYGIHAVNSILTHSPERLIEVFVLKRREDKRLQPLLNELYSLGIGVQFVNRQTLDKKADGEVHQGVIARVQAAKELNENDLDEILANKQNPLLLVLDGVTDPHNLGACLRTADAAGAVAVIVPKDKSAQLTSIARKVACGAAETVPLIRVTNLSRTLRDLQQNHNIWVVGTAGEATETIYQSKLTGPLALVMGAEGEGMRRLTREHCDQLISIPMAGSVSSLNVSVATGVCLFEIARQRLGS

SEQ ID NO: 3499 - protein, 782 aa, H. influenzae strain 86-028NP; identical to SEQ ID NO: 695

SEQ ID NO: 3500 - protein, 235 aa, H. influenzae strain 86-028NP
MKLTSPIFNDQQKRRAIIWLSFFHIFIIAASNYFVQIPFEITLKLTALGAANDFSFHSTWGTLTFPFIFLATDLTVRIFGAEDARKIIFVVMFPALIVSYVISVLFSESKFQGFESLTHFDLFVFRIAIASFAAYVVGQLLDVIVFNRLRQLKTWWVAPTSSMTFGSMADTFVFFSVAFYQSADPFMAEHWAQLGFVDYLFKLFVGIILFVPAYGVVLNVILRKLQMLVTERVPA

SEQ ID NO: 3501 - protein, 229 aa, H. influenzae strain 86-028NP
MILQPLFYLCFSSNLKGEKMELHNIRDEYTKRVLSQHDCHKNPISQFEQWQKEAIHAQVNEPTAMNIATVDEQGRPNSRMVLLKEVNEQGFVFFTNYLSRKGGCIERNPYVALTFFWPELERQVRIEGKAVKIPAEQSDKYFATRPYTSRIGAWASEQSAVISNYKSLLAKAALVAAKHPLNVPRPDYWGGYLVVPETVEFWQGRPSRLHDRIRYRKESDNWIRERLSP

SEQ ID NO: 3502 - protein, 616 aa, H. influenzae strain 86-028NP
MKNEIDIKKLRNIAIIAHVDHGKTTLVDKLLQQSGTFESARGDVDERVMDSNDLEKERGITILAKNTAINWNDYRINIVDTPGHADFGGEVERVLSMVDSVLLVVDAFDGPMPQTRFVTQKAFAHGLKPIVVINKVDRPGARPDWVVDQVFDLFVNLGASDEQLDFPIIYASALNGVAGLEHEDLAEDMTPLFEAIVKYVESPKVELDAPFQMQISQLDYNNYVGVIGIGRIKRGSIKPNQPVTIINSEGKTRQGRIGQVLGHLGLQRYEEDVAYAGDIVAITGLGELNISDTICDINAVEALPSLTVDEPTVTMFFCVNTSPFAGQEGKYVTSRQILERLNKELVHNVALRVEETPNPDEFRVSGRGELHLSVLIENMRREGYELAVSRPKVIYRDIDGKKQEPYEQVTIDVEEQHQGSVMEALGIRKGEVRDMLPDGKGRVRLEYIIPSRGLIGFRGDFMTMTSGTGLLYSSFSHYDEIKGGDIGQRKNGVLISNATGKALGYALFGLQERGKLMIDANVEVYEGQIIGIHSRSNDLTVNCLQGKKLTNMRASGKDDAIVLTTPVKFSLEQAIEFIDDDELVEVTPESIRIRKKLLTENDRKRANRTTTSTSTH

SEQ ID NO: 3503 - protein, 326 aa, H. influenzae strain 86-028NP
MNGTICPINQSINQSINQSINQSINQSINQSKSVIIAGNGTSLKSIDYSLLPKDYDVFRCNQFYFEDHYFLGKKIKKVFFNCSVIFEQYYTFMQLIKNNEYEYADIILSSFLNLGDSELKKIQRLEKLLPQIDLGHSYLKKLRAFDAHLQYHELYENKRITSGVYMCAVATAMGYKDLYLTGIDFYQEKGNPYAFHHQTENIIKLLPSFSQNKSQSDIHSMEYDLNALYFLQKHYGVNIYCISPESPLCNYFPLSPLNNPITFILEEKKNYTQDILIPPKFVYKKIGIYSKPRIYQNLIFRLIWDILRLPNDIKHALKAKKMRLRK

SEQ ID NO: 3504 - protein, 470 aa, H. influenzae strain 86-028NP
MSNAIASVFKLIEENDIRFVLLRFTDIKGKEHGVSIPVSLVDEDMFEDGKMFDGSSVEGWKTINKADMLLMPIAETAVVDPFAQIPTLSIRCSVYEPTTMQSYDRDPRSIAIRAENYMRSTGIADQAFFGPEPEFFLFDDVRFNVSMNKASFSIDDIEAAWNTNKKYEEGNNAYRPLKKGGYCAVAPIDSAHDIRSEMCLILEEMGLVIEAHHHEVATAGQNEIATKFNTLTLKADETQIYKYVVQNVALEHGKTACFMPKPITGDNGSGMHCNMSLSKDGKNIFQGDKYAGLSETALYYIGGIIKHAKALNAFTNPSTNSYKRLVPGYEAPVLLAYSASNRSASIRIPAVTNPKAIRVEARFPDPLANPYLAFAALLMAGLDGVVNKIHPGDAMDKNLYDLPPEELKDIPAVASSLEEALNSLEKDYEFLTQGGVFAKDFIDAFISIKRKEVERLNMAPHPVEFEMYYA

SEQ ID NO: 3505 - protein, 347 aa, H. influenzae strain 86-028NP
MSNTNRTILVTGGAGFIGSALVHYLLEKTHNKIVNVDKLTYAGNLASLKTVENHPRYAFVQADICDTKALSYIFSQYQPDAVIHLAAESHVDRSINASSEFIQTNIVGTYCLLESTLDYWHRLDNQKKSSFRFLHISTDEVYGDLKSNEGLFTETSAYKPSSPYSASKAASDHLVQAWYRTYGLPTIITHSSNNYGPYQYPEKLIPLMILNAIEGKTLPIYGDGLQIRDWLFVEDHIDALYNVLMKGNIGETYNIGGNNEKSNIDVVRSICSLLEEFLPNKPKHIDKYEDLICYVQDRPGHDLRYALDTSKINHKLGWIPKETFESGLRKTVIWYLNHQEWCQKVSE

SEQ ID NO: 3506 - protein, 434 aa, H. influenzae strain 86-028NP
MQITLSNNLANDAWGKNAILSFDSNKATIHLKNNEKTDRTLVQQAARKLRGQGIKNVELLGEEWDLEFCWAFYQGFYTAKQDYGIEFPHLDHDLQDELLARIECGDFVRGIINEPAQSLTPVKLAERAAEFILNQADIYNEKSAVSFKIISGEELEQQGYHGIWTVGKGSANLPAMLQLDFNPTQDPNAPVLACLVGKGITFDSGGYSIKPSDGMSTMRTDMGGAALLTGALGFAIARGLNQRVKLYLCCAENLISNNAFKLGDIITYKNGVTAEVLNTDAEGRLVLADGLIEADSQNPDFIIDCATLTGAAKMAVGNDYHSVLSMDDDLVKNLFQSAQEENEPFWRLPFEDFHRSQINSSFADIANIGSVPVGAGASTATAFLSYFIKNYQQNWLHIDCSATYRKSSSDLWAVGATGIGVQTLANLMLSKSLK

SEQ ID NO: 3507 - protein, 141 aa, H. influenzae strain 86-028NP
MMTERTFSIIKSDAVKRNLIGAILTRFEQNGFKIIASKMVRLTREQAEGFYAEHQGKEFFAPLVEYMMSSPIVVSVLEKENAVKDYRTLIGTTNPETAEEGTIRKDFALSQRENSVHGSDSIENANREIAYFFTDCEIFER

SEQ ID NO: 3508 - protein, 390 aa, H. influenzae strain 86-028NP
MKFIDESLIRIEAGDGGNGCVSFRREKFIPKGGPDGGDGGDGGDVYLQADENLNTLIDYRFNKRFAAERGENGRSSDCTGRRGKDIILPVPVGTRAIDNDTKETLGDLTQHGQKMLVAKGGYHGLGNTRFKSSVNRAPRQKTMGTPGEKRDLLLELMLLADVGMLGLPNAGKSTFIRAVSAAKPKVADYPFTTLVPSLGVVKVDDSHSFVVADIPGLIEGAADGAGLGIRFLKHLERCRVLIHLVDIAPIDGSNPADNVAIIESELFQYSEKLSEKPRWLVFNKIDTMSDEEAEERVREITEQLGWEEDYYLISAATRKNVPPLCRDIMDFIIANPREAETQQVAPEEVKFKWEDYHQEQLAGYQFDDDEDWDDDWTEEDDEGIEFIYKP

SEQ ID NO: 3509 - protein, 306 aa, H. influenzae strain 86-028NP
MKQQPLLGFTFALITAMAWGSLPIALKQVLSVMNAQTIVWYRFIIAAVSLLALLAYKKQLPELMKVRQYAWIMLIGVIGLTGNFLLFSSSLNYIEPSVAQIFIHLSSFGMLICGVLIFKEKLGLHQKIGLFLLLIGLSLFFNNRFAVFSGLNQYSTGVILSIGGALIWVAYGMAQKLMLRKFNSQQILLMMYLGCAIVFMPMAEFSQVQELTPLALICFIYCCLNTLIGYGSYAEALNRWDVSKVSVVITLVPLFTILFSHIAHYFSPVDFAAPELNNISYIGAFVVVCGAILSAIGHKLLPHKNH

SEQ ID NO: 3510 - protein, 85 aa, H. influenzae strain 86-028NP
MATKKAGGSTRNGRDSEAKRLGVKRFGGESVLAGSIIVRQRGTKFHAGNNVGMGRDHTLFATADGKVKFEVKGEKSRKYVSIVTE

SEQ ID NO: 3511 - protein, 103 aa, H. influenzae strain 86-028NP
MYAVFQSGGKQHRVSEGQVVRLEKLELATGATVEFDSVLMVVNGEDVKIGAPVVAGAKVVAEVIAQGRGEKVKIVKFRRRKHSRKQQGHRQWFTEVKITGIQA

SEQ ID NO: 3512 - protein, 329 aa, H. influenzae strain 86-028NP
MKKQDLMSIDEIQKLADPDMQKVNQNILAQLNSDVPLIGQLGFYIVQGGGKRIRPLIAVLAARSLGFEGSNSITCATFVEFIHTASLLHDDVVDESDMRRGRATANAEFGNAASVLVGDFIYTRAFQLVAQLESLKILSIMADATNVLAEGEVQQLMNVNDPETSEANYMRVIYSKTARLFEVAGQAAAIVAGGTEAQEKALQDYGRYLGTAFQLVDDVLDYSANAQALGKNVGDDLAEGKPTLPLLHAMRHGNAQQAALIREAIEQGGKREAIDEVLAIMTEHKSLDYAMNRAKEEAQKAVDAIEILPESEYKQALISLAYLSVDRNY

SEQ ID NO: 3513 - protein, 245 aa, H. influenzae strain 86-028NP
MNTELQPKLEKSAVNFQAKPRKQKIRKDPNAPFIREKLELPDGHNKLLLHSCCAPCSGEVMEAILASGIEFTIYFYNPNIHPLKEYLIRKEENIRFAKKFGIPFIDADYDRQNWFDRAKGMEWEPERGIRCTMCFDMRFEKAAEYAHEHGFPVFTSCLGISRWKDMNQINGCGHRAAEKYDDVVYWDYNWRKEGGSQRMIEISKRERFYQQEYCGCVYSLRDSNKWREETGRQKIEIGKLYYSAD

SEQ ID NO: 3514 - protein, 456 aa, H. influenzae strain 86-028NP
MTIESILSAIDSFIWGAPLLILLSGTGLYLTLRLGFIQIRYLPRALGYLFKKDKGGKGDVSSFAALCTALAATIGTGNIVGVATAVQAGGPGAIFWMWLVALLGMATKYAECLLAVKYRVRDKNGFMAGGPMYYIERGLGIKWLAKLFALFGVMVAFFGIGTFPQVNAITHAMQDTFNIPVLVTAIIVTLLVGLIILGGVKRIATASSVIVPFMAILYVTTSLVIILLNIEKVPDAILLIIDSAFDPQAALGGAVGLTVMKAIQSGVARGIFSNESGLGSAPIAAAAAQTREPVRQGLISMTGTFLDTIIVCTMTGIVLVLTGAWNNPELAGATVTNYAFAQGLGTSIGATIVTVGLLFFAFTTILGWCYYGERCFVYLVGIRGVKLYRLAYIMLVGLGAFLHLNLIWIIADIVNGLMAFPNLIALIGLRKVIIEETKDYFQRLKINHYDQDEVIK

SEQ ID NO: 3515 - protein, 236 aa, H. influenzae strain 86-028NP
MTTPKILVVEDEIVTRNTLKGIFEAEGYDVFEAENGVEMHHILANHNINLVVMDINLPGKNGLLLARELREELSLPLIFLTGRDNEVDKILGLEIGADDYLTKPFNPRELTIRARNLLHRTMSHQEKENTFGREFYRFNGWKLDLNSHSLITPEGQEFKLPRSEFRAMLHFCENPGKLQTREELLKKMTGRELKPQDRTVDVTIRRIRKHFEDHPNTPNIIMTIHGEGYRFCGDIE

SEQ ID NO: 3516 - protein, 579 aa, H. influenzae strain 86-028NP
MKKLFLFFTLIFTAFAANSGLFDKKQTFLKVDDAFAFSATLSTDKSQLQAHWDIADGYYLYQDKISAELVGKSNPLSLHTQQAAELHQDPYFGEVKVFTHSIDGIFRGTFNNADDKVEITYQGCTEGFCYPPETKVLRIGDLAVSQEQIVEKTVEKNTALLSEQDRLADGLFHSKWTIFGFFLLGLGLAFTPCVLPMLPLLSAIVIGQQQRPNMMRAFSLAFLYVQGMALTYTLLGLAVAAIGLPFQIALQHPYVMIGLSILFVALALSMFGLFTIQLPNSLQNKLNTWSQKQTSGAFGGAFAMGMIAGLVASPCTSAPLSGALLYVAQSGDLFTGAATLYLLALGMGVPLMLITLFGNKILPKSGEWMNTVKQTFGFVMLALPVFLLSRILPEVWEPRLWAGLATVFFIWFALQMSKNGFGYAIKIISFALAMVTVQPLQNWIWQTQTTTQSAVENMPVSQVKFKQIKNTEELDRTLAENPHSIAMLDLYADWCVACKEFEKLTFSDPQVQQQFQNILLLQVNMTKNSPENKALMERFNVMGLPTILFFDQQNNEIQGSRVTGFMDADAFSNWLKALH

SEQ ID NO: 3517 - protein, 134 aa, H. influenzae strain 86-028NP
MNNLEKYRPYFLAFLRIVAAYMFILHGTAKLLEFPISMTGGNGAVGDPMLLVAGVIEIVGSILLILGLFTRQAAFILSGEMAYAYFFMHVAGKGNLFFPIANGGELALLYSVLFLYFVFSGAGACALDNKFFKK

SEQ ID NO: 3518 - protein, 532 aa, H. influenzae strain 86-028NP
MTDRPIRQALLSVSDKTGIVEFAQGLVKRGVKLLSTGGTAKLLAQNGLPVIEVSNYTGFPEMMDGRVKTLHPKIHGGILGRRGTDDAIMQQHSIEGIDMVVVNLYPFAATVAKPDCTLTDAVENIDIGGPTMVRSAAKNHKDVAIIVNNNDFNAILTEMDKHQNSLTFETRFDLAIKAFEHTAQYDSMIANYFGQLVKPYHIAEEEEANAKCGQFPRTLNLNFVRKQTMRYGENSHQNAAFYVDLNVKEASVATANQLQGKALSYNNIADTDAALECVKEFDEPACVIVKHANPCGVALGKDILDAYNRAYQTDPTSAFGGIIAFNRELDEKTANEIVERQFVEVIIAPKVSAEAQEVMKRKKNVRLLECGEWTSRSERLDFKRVNGGLLVQDADLGMVGVDDLKVVSKRQPTEQELKDLLFCWKVAKFVKSNAIVYAKDNQTIGIGAGQMSRVYSAKIAGIKAQDEGLTVAGCVMASDAFFPFRDGIDAAAKVGIQCVIHPGGSMRDQEVIDAADEHNMVMVLTGMRHFRH

SEQ ID NO: 3519 - protein, 429 aa, H. influenzae strain 86-028NP
MNILIIGNGGREHALAWKVAQSPLADKVFVAPGNAGTALEHKVENVNISATDIPALVKFAQDKQIGLTIVGPEAPLVIGVVDAFREAGLKIFGPAKAAAQLEGSKAFTKDFLARHKIPTAEYQNFTEVEPALTYLREKGTPIVVKADGLAAGKGVIVAMTLQEAEDAVRDMLSGNAFGEAGSRVVIEEFLDGEEASFIVMVDGKNVEPMATSQDHKRVGENDTGLNTGGMGAYSPAPVITPEIHSRIMKEVIYPTVNGMAAEGSVYTGFLYAGLMIMPNGQPKVIEFNCRFGDPETQPIMLRLKSDLVELCLKACDGKLDEVISQWDPRASLGIVLAAEGYPKDYRKGDEISGLPKSAVKNEKVFLAGVAEQEGKLVTNGGRVLCVTALGESVFEAQQKALKLAEQIQWSGRFYRRDIGYRAVEREQAK

SEQ ID NO: 3520 - protein, 421 aa, H. influenzae strain 86-028NP
MFTRNMTIADYDPVLWQAIQDENRRQEEHIELIASENYASPRVMEAQGSQFTNKYAEGYPGKRYYGGCEYADIVEQLAIDRAKELFGADYVNVQPHSGSQANAAVYGALINAGDTILGMDLAHGGHLTHGAKVSFSGKIYNSVLYGITADGLIDYEDVRQKALECKPKLIVAGFSAYSQVVDWAKMREIADEVGAYLFVDMAHVAGLIAAGLYLNPLPHAHVVTTTTHKTLGGPRGGLILSSCGDEEIYKKLQSSVFPANQGGPLVHIIAAKAVCFKEALEPQYKEYQANVIKNAKAMVEVFKQRGYDVVSNGTENHLFLVSFIKQGLTGKAADAALGKANITVNKNAVPNDPQKPFVTSGIRVGTPSVTRRGFNENDVRELAGWMCDVLDALGKENEEQVIAETKEKVLAICKRLPVYPK

SEQ ID NO: 3521 - protein, 210 aa, H. influenzae strain 86-028NP
MGNYMTYIVGLTGGIGSGKTTIANLFTDLGVPLVDADVVAREVVAKDSPLLSKIVEHFGAQILTEQGELNRAALRERVFNHDEDKLWLNNLLHPAIRERMKQKLAEQTAPYTLFVVPLLIENKLTALCDRILVVDVSPQTQLARSSQRDNNNFEQIQRIMNSQVSQQERLKWADDVINNDSELAQNLPHLQQKVLELHQFYLQQAENKNA

SEQ ID NO: 3522 - protein, 68 aa, H. influenzae strain 86-028NP
MPDEMIEVPCPICQKSVPWINESTFRPFCSKRCQLIDLGEWAAEEKAIPSDTADFAMDPNVSDGWSIK

SEQ ID NO: 3523 - protein, 418 aa, H. influenzae strain 86-028NP
VIFMQQDYLSQQRFSALPLHPIVRGALAKKGFDFCTPIQALSLPISLNGRDVAGQAQTGTGKTMAFLTATFHHLLTHQDPNLEYPHPRTLILAPTRELAVQISNDAEFLAKASGLKTALAYGGDGYDKQLQVIERGVDILIGTTGRVIDYVKQGVIGLDEIQVVVLDEADRMFDLGFIRDIRYLLRKCPAPQARLTMLFSATLSYKVRELAFEDMNDPEYIEIEPEQKTGHRIKEELFYPSNQDKMALLLTLMEDEWPERCIVFANTKHRCEEIWGYLAADGHRVGLLTGDVAQKKRLSLLKQFTDGDLDILVATDVAARGLHISDVTHVFNYDLPDDREDYVHRIGRTGRAGESGVSISFACEEYAMNLPGIEEYIGHSIPVSQYETEALLELPKPYRLKRAVPPQGHTRHRSYHTK

SEQ ID NO: 3524 - protein, 187 aa, H. influenzae strain 86-028NP
MRQAKTDLAEQIFLATDRLMAKEGLDRLSMHKIAKEANVAAGTIYLYFKNKDELLEQFAHRVFSMFMATLEKDFDESKPFFEQYRQMWKNIWYFLQENPTILSNLKQYESLPNFKDICKNVKNCRWDLFCDQAKKAGLLAELSEDILFLLSLKTAINLASDAKFIDFDLKPEILESVIERSWRAIQK

SEQ ID NO: 3525 - protein, 398 aa, H. influenzae strain 86-028NP
MSQTQHQRPKRSHIFLMKIILVVFVLIFVGVIGFNIIKGVMISRAIAEMPESSSPVTALEVQPREWTPVINTTGLVRPNQGALLSTQNAGTISQVLVQNGQNVKKGEVLVELDSSVERANLQAAQAQLSALRQTYQRYVGLLNSNAVSRQEMDNAKAAYDAQLANIESLKAVIERRKIVAPFDGKAGIVKINVGQYVNVGTEIVRVEDTSSMKVDFALSQNDLDKLHIGQRVTATTDARLGETFSARITAIEPAINSSTGLVDVQATFNPEDGHKLLSGMFSRLRIALPTETNQVVVPQVAISYNMYGEIAYLLEPLSEEEKGKMSGNEKLDRLYRAKQITVFTKDRQGVYAQLQGNEVKAGDKIITGGQQGIGNGSLVEWIKKDIVGAVEPAHKTPL

SEQ ID NO: 3526 - protein, 1032 aa, H. influenzae strain 86-028NP
MYEEIRMKFTDIFIRRPVLAVSISLLMIILGLQAISKLAVREYPKMTTTVITVSTAYPGADANLIQAFVTSKLEESIAQADNIDYMSSTSAPSSSTITIKMKLNTDPAGALADVLAKVNAVKSALPNGIEDPSVSSSSGGSGIMYISFRSKKLDSSQVTDYINRVVKPQFFTIEGVAEVQVFGAAEYALRIWLDPQKMAAQNLSVPTVMSALSANNVQTAAGNDNGYYVSYRNKVETTTKSVEQLSNLIISSNGDDLVRLRDIATVELNKENDNSRATANGAESVVLAINPTSTANPLTVAEKIRPLYESIKTQLPDSMESDILYDRTIAINSSIHEVIKTIGEATLIVLVVILMFIGSFRAILIPILAIPISLIGVLMLLQSFNFSINLMTLLALILAIGLVVDDAIVVLENIDRHIKAGETPFRAAIIGTREIAVPVISMTIALIAVYSPMALMGGITGTLFKEFALTLAGAVFISGVVALTLSPMMSSKLLKSNAKPTWMEERVEHTLGKVNRVYEYMLDLVMLNRKSMLAFAVVIFSTLPFLFNSLSSELTPNEDKGAFIAIGNAPSSVNVDYIQNAMQPYMKNVMETPEVSFGMSIAGAPTSNSSLNIITLKDWKERSRKQSAIMNEINEKAKSIPEVSVSAFNIPEIDTGEQGAPVSIVLKTAQDYKSLANTAEKFLSAMKASGKFIYTNLDLTYDTAQMTISVDKEKAGTYGITMQQISNTLGSFLSGATVTRVDVDGRAYKVISQVKRDDRLSPESFQNYYLTASNGQSVPLSSVISMKLETQPTSLPRFSQLNSAEISAVPMPGISSGDAIAWLQQQANDNLPQGYTYDFKSEARQLVQEGNALTTTFILAVVIIFLVLAIQFESIRDPMVIMISVPLAVSGALVSLNILSFFSIAGTTLNIYSQVGLITLVGLITKHGILMCEVAKEEQLNYGKTRIEAITHAAKVRLRPILMTTAAMVAGLIPLLYATGAGAVSRFSIGIVIVAGLSIGTIFTLFVLPVVYSYIATEHKPLPVFDENKTTH

SEQ ID NO: 3527 - protein, 156 aa, H. influenzae strain 86-028NP
MRLTEEQRQVLIQIERDQKAADEARKLAEQQRIEDATRTQSKKTEDMKNTESEIVKLESIKKQDSQKIESAKKVEQIKTVNNVRDSKKFGLQCGAFKNRAQAENLQGRLQMTGLNAQIQTNGEWNRVRVASFDTRELAVQAQSRAKTVTDCVVIGM

SEQ ID NO: 3528 - protein, 510 aa, H. influenzae strain 86-028NP; identical to SEQ ID NO: 765

SEQ ID NO: 3529 - protein, 390 aa, H. influenzae strain 86-028NP
MTKTAIETPSNKSVSNKTNRKKGLSIFILLLLIIGIACALYWFFFLKDFEETEDAYVGGNQVMVSSQVAGNVAKINADNMDKVHAGDILVELDDTNAKLSFEQAKSNLANAVRQVEQLGFTVQQLQSAVHANEISLAQAQGNLARRVQLEKMGAIDKESFQHAKEAVELAKANLNASKNQLAANQALLRNVPLREQPQIQNAINSLKQAWLNLQRTKIRSPIDGYVARRNVQVGQAVSVGGALMAVVSNEQMWLEANFKETQLTNMRIGQPVKIHFDLYGKNKEFDGVINGIEMGTGNAFSLLPSQNATGNWIKVVQRVPVRIKLDPQQFTETPLRIGLSATAKVRISDSSGAMLREKTEPKTLFSTDTLKYDESAVENLIESIIQQNSH

SEQ ID NO: 3530 - protein, 160 aa, H. influenzae strain 86-028NP
MTFSLIVAITLNNVIGKDNQMPWHLPADLAWFRQKTTGKPVIMGRKTFESIGRPLPKRTNIVLSRQLFEHEGVIWKDSFESAVNFVRDFDEIMLIGGGELFKQYLPKADKLYLTQIQTELDGDTFFPQLNWEEWEIEFDEYRKADAQNRYDCRFLILTRK

SEQ ID NO: 3531 - protein, 368 aa, H. influenzae strain 86-028NP
MNKKTIVVKFGTSTLTQGSPKLNSPHMMEIVRQIAQLHNDGFRIVIVTSGAIAAGRHYLNHPQLPPTIASKQLLAAVGQSQLIQAWEKLFAIYDIHIGQLLLTRADIEDRERFLNARDTLHALLDNHIIPVINENDAVATAEIKVGDNDNLSALVAILVQAEQLYLLTDQQGLFDSDPRKNPEAKLIPVVEQITDHIRSIAGGSGTNLGTGGMMTKIIAADVATRSGIETIIAPGNRPNVIADLAYEQNIGTKFIAHQSDRLESRKQWLFAAPSAGIITIDDGAKNAILEQNKSLLPAGIINVEGRFSRGEVVKICTQSGKDIVLGMPRYNSDALQLIKGRKSADIENVLGYEYGAVAMHRDDMIILS

SEQ ID NO: 3532 - protein, 196 aa, H. influenzae strain 86-028NP
VIDFDGYRPNVGIVICNRKGQVLWAKRCGQNSWQFPQGGINDNESAEQAMYRELHEEVGLQPKDVRLLYVSKHWLRYKLPKRLLRYDSKPMCIGQKQRWFLLQLVGDEKNINMKTTKSPEFDGWRWVSFWYPVRQVVSFKRDVYRKVMKEFASVLFTDNPPIFSASREANSQSNSANKKYSQTKYTKRHFYKSKGQ

SEQ ID NO: 3533 - protein, 264 aa, H. influenzae strain 86-028NP
MFTFILLCLLVGALAGFLAGLFGIGGGLVIVPTLVYLLPIVDVPESLLMSTALGTSFATIVITGIGSAQRHHKLGNIVWQAVRILAPVIMLSVFICGLFIGRLDREISAKIFACLVVYLATKMVLSIKKDQVTTKPLTPLASVIGGILIGMASSAAGIGGGGFIVPFLTARGINIKQAIGSSAFCGMLLGVSGMFSFIVSGWGNPLMPEYSLGYIYLPAVLGITATSFFTSKLGASATAKLPVSTLKKGFALFLIVVAINMFLK

SEQ ID NO: 3534 - protein, 268 aa, H. influenzae strain 86-028NP
MNSNYLLLPHFDPSIFTLGDSNIGLRWYGLMYLLGFVFARWLAVRRANRPNSGWTVDQVDTLLFNGFMGVFIGGRVGDVFFYNLDHFLQEPLYLFRVWEGGMSFHGGLIGVIVAMIWTSYSQKRNFWQTADFVAPLIPFGLGLGRIGNFINLELWGRETNVPWAMIFPNDPLLLPRHPSQLYEAFLEGLVLFAILNIFIKKPRPMASVAGLFLIGYGVFRFIVEYVREPEVENFFGIITRGQALCLPMIIGGAFIMAWAYSRKSAVIK

SEQ ID NO: 3535 - protein, 283 aa, H. influenzae strain 86-028NP
MKQYLDLCRRIVSEGEWVANERTGKHCLTVINADLEYDVANNQFPLITTRKSYWKAAIAEFLGYIRGYDNAADFRALGTKTWDANANVNAAWLANPHRRGVDDMGRVYGVQGRAWRKPNGETIDQLRKIVNNLTKGIDDRGEILTFFNPGEFDLGCLRPCMHTHTFSLVGDTLHLTSYQRSCDVPLGLNFNQIQVFTFLALMAQITGKKAGKAYHKIVNAHIYEDQLELMRDVQLKREPFPLPKLEINPDIKTLEDLETWVTMDDFKVVGYQSHEPIKYPFSV

SEQ ID NO: 3536 - protein, 173 aa, H. influenzae strain 86-028NP
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDN

SEQ ID NO: 3537 - protein, 104 aa, H. influenzae strain 86-028NP
MENKADRYQKAVNIMDVLEQSPFAKIIKKGLAINELNQKFNRIFPQEFHGKFRIGNITDHLIFIEVSNAIVRQGILFKQIELLTLIQEEFPQVTGFEITINPGF

SEQ ID NO: 3538 - protein, 103 aa, H. influenzae strain 86-028NP
MRRMISGTVKPNFWSRLLLSIIAIFALPNAQSFENQNNTENYSSSVSIQQALETVKVAREVQRQAIPQPSISRQTEKQPKIQPHFLADVLNLSAPIRAGPLLI

SEQ ID NO: 3539 - protein, 901 aa, H. influenzae strain 86-028NP
MSILTRIFGSRNERVLRKLKKQVVKINKMEPAFEALSDDELKAKTQEFRDRLSGGETLQQILPEAFATVREASKRVLGMRHFDVQLIGGMVLTNRCIAEMRTGEGKTLTATLPCYLIALEGKGVHVVTVNDYLARRDAETNRPLFEFLGMSVGVNIPGLSPEEKRAAYAADITYATNSELGFDYLRDNLAHSKEERFQRTLGYALVDEVDSILIDEARTPLIISGQAENSSELYIAVNKLIPSLIKQEKEDTEEYQGEGDFTLDLKSKQAHLTERGQEKVEDWLITQGLMPEGDSLYSPSRIVLLHHVMAALRAHTLFEKDVDYIVKDGEIVIVDEHTGRTMAGRRWSDGLHQAIEAKEGVDVKSENQTVASISYQNYFRLYERLAGMTGTADTEAFEFQQIYGLETVVIPTNRPMIRDDRTDVMFENEQYKFNAIIEDIKDCVERQQPVLVGTISVEKSEELSKALDKAGIKHNVLNAKFHQQEAEIVAEAGFPSAVTIATNMAGRGTDIILGGNWKAQAAKLENPTQEQIEALKAEWEKNHEIVMKAGGLHIIGTERHESRRIDNQLRGRSGRQGDPGSSRFYLSLEDGLMRIYLNEGKLNLMRKAFTVAGEAMESKMLAKVIASAQAKVEAFHFDGRKNLLEYDDVANDQRHAIYEQRNHLLDNDDISETINAIRHDVFNGVIDQYIPPQSLEEQWDIKGLEERLSQEFGMELPISNWLEEDNNLHEESLCERIVEIAEKEYKEKEALVGEDAMRHFEKGVMLQTLDELWKEHLASMDYLRQGIHLRGYAQKDPKQEYKKESFRMFTEMLDSLKHQVITTLTRVRVRTQEEMEEAERARQEMAARINQNNLPVDENSQTTQNSETEDYSDRRIGRNEPCPCGSGKKYKHCHGSRVARQ

SEQ ID NO: 3540 - protein, 136 aa, H. influenzae strain 86-028NP
MDKKIIQVAAGIIRNEFGQIYLTQRLEGQDFAQSLEFPGGKVDAGETPEQALKRELEEEIGIVALNAELYERFQFEYPTKIISFFFYLVNEWIGEPFGREGQEGFWVEQRALDAGQFPPANAKLIHRLLNETHNFI

SEQ ID NO: 3541 - protein, 618 aa, H. influenzae strain 86-028NP
MSQLANPELMKVVILLASSVTIVPLFKRLGLGSVLGYLVAGCLIGPSVFGIVQDPTAVVHLAELGVVMFLFIIGLEMYPERLWAMRKAIFGRGLLQVGLCGCLLTFSGIYLLGLTKEVSFIAGMGFTLSSTAIVMQSLEERGLTSTSKGQRVISTLIFEDIAIVPLLASVAFLAPHSKEATPHTDWVSIGIALSAVVGLIVTGKWLMNPLFRLISKARIREMMTAGALLVVLGAALAMEIGGLSMAMGAFVAGVMMSESAFRHQLEADIEPFRGLLLGLFFMGVGMSLDLHLVFNHWILLLGIVFLYILGKASAVYIIARITRLDHREAIGRMSLMAHGGEFAFVLFSAAATAEVISNEEQATFTAAVIISMLFSPIIAQIARKLIQRTEPKHLDQLDENDLDSIVDLEDNVLVIGFGRFSQIVCQTLLIRGISVSVIDRNIENIRAAAKFGFKVYYGDGIRLDVLRAAGIEKAKCVVLGINDTQRIEHIVSQMKEAYPNLPILTRTYDRKTTVSLIKQDVDFIVRETFESAITLSRATLMKLGIDKIEAEEIIKEVRTLDQERLNEEVLHGFSNEIVKKYWTPRPFIKPHLDTKALNKETEEILSEKIEEEISNDHS

SEQ ID NO: 3542 - protein, 254 aa, H. influenzae strain 86-028NP
MNNKISVYDKDNFFELYQKLRANPISLNEIIEKPTMLSLLPNLKGKKLLDLGCGTGGHLQLYLERGAAKVIGTDLSEKMLEQAEKDLQKCGQFSGRFSLYHLPIEKLAELPESHFDVITSSFAFHYIENFPTLLSTIHDKLSSNGTLIFSQEHPITTCHKEGERWEKNDKKQQVAYRLNHYREEGERNRNWFKQPFQTYHRTTATIINNLIHARFQIEQMEEPMLADQPQWHNEFKDLSHRPPLLFIKARKVEK

SEQ ID NO: 3543 - protein, 251 aa, H. influenzae strain 86-028NP
VEAQPQQKENIMAQVSMRDMINAGVHFGHQTRYWNPQMKPFIFGARNGVHIINLEKTLPLFNEALAELTRIASNNGKVLFVGTKRAASEAVQAAALDCQQYYVNHRWLGGMLTNWKTVRQSIKRLKDLETQSQDGTFDKLTKKEALMRSREMEKLELSLGGIKDMGGLPDALFVIGADHEHIAVKEANNLGIPVFAIVDTNSTPAGVDFVIPGNDDATRAIQLYVSAAAAAVKEGRGNEAQVAEELAADAE

SEQ ID NO: 3544 - protein, 283 aa, H. influenzae strain 86-028NP
MAEITASLVKELRDRTGAGMMECKKALVEANGDIELAIDNMRKSGQAKAAKKAGRVAAEGVILARVENGFGVLVEMNCETDFVAKDAGFLGLANEVADFAAANKGTTIEALQAQFEEKRAALVAKIGENMNIRRVAYLDGQVIAQYLHGAKIGVLVAGEGSADELKKVAMHVAASKPEFVNPEDVSAEVVEHERQIQIDIAINSGKPKEIAEKMVEGRMKKFTGEVSLTGQAFVMDPSVSVGDFLKSVNTSVSNFIRLEVGEGIEKKEEDFAAEVAKITGGNA

SEQ ID NO: 3545 - protein, 341 aa, H. influenzae strain 86-028NP
MQKSYSLQELATQIGATVRGNADVVVENIAPLDKAQSNQLTFISNVKFRALLKDSKAGILVVSEEDVEHCSPESNLLIVKDPYVAYAILAQYMDSTPKAAQGIAKSAVIFDGVLLGENVSIGANAVIEEGVVLGDNVIIGANCFVGKNTKIGSGTQLWANVTVYHNVEIGANCLIQSGTVIGSDGFGYANDRGRWIKIPQVGQVIIGNNVEIGANTCIDRGALDATIIEDNVIIDNLCQIAHNVHIGTGTAVAGGVIMAGSLTVGRYCLIGGASVINGHMEICDKVTITGMGMVMRPITEPGVYSSGIPLQTNKEWRKTAALTLGIDGINKRLKALEKKIS

SEQ ID NO: 3546 - protein, 197 aa, H. influenzae strain 86-028NP
MKNIAKVTALALGIALASGYASAEEKIAFINAGYIFQHHPDRQAVADKLDAEFKPVAEKLAASKKEVDDKIAAARKKVEAKVAALEKDAPRLRQADIQKRQQEINKLGAAEDAELQKLMQEQDKKVQEFQAQNEKRQAEERGKLLDSIQTATNNLAKAKGYTYVLDANSVVFAVEGKDITEEVLKSIPASEKAQEKK

SEQ ID NO: 3547 - protein, 800 aa, H. influenzae strain 86-028NP
MKKLLIASLLFGTTTTVFAAPFVAKDIRVDGVQGDLKQQIRASLPVRAGQRVTDNDVANIVRSLFVSGRFDDVKAHQEGDVLVVSVVAKSIISDVKIKGNSIIPTEALKQNLDANGFKVGDVLIREKLNEFAKSVKEHYASVGRYNATVEPIVNTLPNNRAEILIQINEDDKAKLASLTFKGNESVSSSTLQEQMELQPDSWWKLWGNKFEGAQFEKDLQSIRDYYLNNGYAKAQITKTDVQLNDEKTKVNVTIDVNEGLQYDLRSARIIGNLGGMSAELEPLLSALHLNDTFRRSDIADVENAIKAKLGERGYGSATVNSVPDFDDANKTLAITLVVDAGRRLTVRQLRFEGNTVSADSTLRQEMRQQEGTWYNSQLVELGKIRLDRTGFFETVENRIDPINGSNDEVDVVYKVKERNTGSINFGIGYGTESGISYQASVKQDNFLGTGAAVSIAGTKNDYGTSVNLGYTEPYFTKDGVSLGGNVFFENYDNSKSDTSSNYKRTTYGSNVTLGFPVNENNSYYVGLGHTYNKISNFALEYNRNLYIQSMKFKGNGIKTNDFDFSFGWNYNSLNRGYFPTKGVKASLGGRVTIPGSDNKYYKLSADVQGFYPLDRDHLWVVSAKASAGYANGFGNKRLPFYQTYTAGGIGSLRGFAYGSIGPNAIYAAQNGNSNSNSNGTFNKISSDVIGGNAITTASAELIVPTPFVSDKSQNTVRTSLFVDAASVWNTKWKSDKSGLDNNVLKSLPDYGKSSRIRASTGVGFQWQSPIGPLVFSYAKPIKKYENDDVEQFQFSIGGSF

SEQ ID NO: 3548 - protein, 443 aa, H. influenzae strain 86-028NP
MSFLWSLGSFIIAIAVLVSVHEYGHFWAARKCGIKVHRFSIGFGKVIWKRIDKYGTEFAVSMIPLGGYVKMLDGRNEVVPAEQKSQAFDSKSVLQRAFVIIAGPLANFIFAIFAYWIIYLYGMPTVKPVIQSITPSSIAAQAHIEPNTQILAVDGEETQDWETINMLLATKMGEPNVEITLSPFNSNIEQQRTLNLTNWIFDPEKESAFEALGIMPMRPKIEMVLSKVVQNSPAEKAGLQIGDKILKENLTALPWQDFIKQVEQGESFSIKVERNGETFDKVLTPVRNQNGKWFVGVSPTLTKLADEYRTELKYGILESLQKGIEKTGQLSLLTLKILGKLLTGDLSLNNLSGPISIAKGAGASANIGLVYFLSFMALISVNLGIMNLFPLPVLDGGHLVFLTMEAVKGKPVSERVQSICYRIGAALLLSLTVFALFNDFLRL

SEQ ID NO: 3549 - protein, 288 aa, H. influenzae strain 86-028NP
MLKQRVLSAIVLIAAVLCALFLFTPFYFALALGAVAILGIWEWTQFARLKQPLIRFFVATFLGVFIFLWLYTEGNYLDAGRVFEQHLQLLLINAVSWWGLALLLVISYPKSAKFWSKNPLLQLLFAFSTLIPFVAGVLRLRLEHYTHDPYHGLFLLLYVFILVWAADSGAYFSGRAFGKRKLAPKVSPGKSWEGVIGGLITALVLSFIFIHFSNNTLVGDRNITGFIILSVATVAISVLGDLTESMFKRESGVKDSSQLIPGHGGVLDRIDSLTAAVPFFSYFYFFVL

SEQ ID NO: 3550 - protein, 239 aa, H. influenzae strain 86-028NP
MIELDQTNIPKHVAIIMDGNGRWAKQKNKMRIFGHANGVTAVRKAVAYARQIGVEVLTLYAFSSENWSRPEQEISALMSLFMQALDREVKKLHKNNICLKIIGDVSRFSETLQEKIKKAENLTEKNTALTLNIAANYGGCWDIIQAAKQIAEKVKKEEMSVSDINNSTFQHHLATQNAPPVDLLIRTSGEQRISNFLLWQIAYAELYFSDVLWPDFNQLEFNHAIASYQQRHRRFGGTE

SEQ ID NO: 3551 - protein, 861 aa, H. influenzae strain 86-028NP
MQEQYRPDMIEPKVQQYWAENKVFKAIKDESKEKYYCLSMFPYPSGRLHMGHVRNYTIGDVISRYQRMLGKNVLQPFGWDAFGLPAEGAAIKNKTAPAKWTYENIAYMKKQLQLLGFGFDWDREIATCKPEYYKWEQWFFTELYKKGLVYKKTSTVNWCPNDETVLANEQVHEGCCWRCDTPVEQKEIPQWFIKITDYAEQLLGGLDALPQWPDMVKTMQRNWIGRSEGVEITFDVANTNEKVAVYTTRPDTFYGVSYLGIAAAHPLASLAAQNNSELAAFIQEAKNAKVAEADLATMEKKGMATGLFAIHPLTGEKLPIWVANFVLMHYGTGAVMAVPAHDQRDFEFAQKYSLQIKQVIEPIADEEIDLTKQAFVEHGKLVNSAEFDGKDFDGAFNGIADKLEKLGVGKRQVNYRLRDWGVSRQRYWGAPIPMLTLENGDVVPAPMEDLPIILPEDVVMDGVKNPIKADPNWAKTTLNGAPALKETDTFDTFMESSWYYARYTCPQYQNGMLDAEEANYWLPVDQYIGGIEHATMHLLYFRFFHKLLRDAGFVTSDEPADKLLCQGMVLADAFYYTSPTNERIWVSPTLVTLERDEKGRIIKATDPEGRELVHSGMTKMSKSKNNGIDPQEMVEKYGADTVRLFMMFASPAEMTLEWQESGVEGAKRFLGRVWNLVYQYQQNPAKTSLDITALSAEQKVLRREVHKTIAKVSDDIGRRQTFNTAIAAVMELMNKLTKASLDSEQDRAVMAEALSAVVRMLYPITPHICFELWQALGNESAIDTAEWVKADEAAMVEDEKLIVVQVNGKVRGKVTVAADADEDTVKTIAFADENVKKFIDNQHIVKVIYVVGKLLNVVVKP

SEQ ID NO: 3552 - protein, 182 aa, H. influenzae strain 86-028NP
VKYLHFTRPTIKVIFMINSIKTLLLIATLAILSACGWHFQQSVTMPNEWRTLALESDDSYNDFTVIMRRKLQENQVNVVNLEQNIPILRINKQITSDQVASIFKHGREAEKLLMLEVEATFRLANGESYPINAKVNRTFFDNARAALAKSEEREVIWNDMREQVARQLIVKIIALQNQIKRK

SEQ ID NO: 3553 - protein, 344 aa, H. influenzae strain 86-028NP
MNRIFPEQLNHHLAQSLARVYLLQGQDPLLLSETEDTLCQVANQQGFDEKNTIQVDSQTDWAQLIESCQSIGLFFSKQILSLNLPENFTALLQKNLQELISVLHKDVLLILQVAKLAKGIEKQTWFITLNQYEPNTILINCQTPTVENLPRWVKNRTKAMGLDADNEAIQQLCYSYENNLLALKQALQLLDLLYPDHKLNYNRVISVVEQSSIFTPFQWIDALLVGKANRAKRILKGLQAEDVQPVILLRTLQRELFTLLELTKPQQRIVTTEKLPIQQIKTEFDRLKIWQNRRPLFLSAIQRLTYQTLYEIIQELANIERLTKQEFSDEVWIKLADLSVKICL

SEQ ID NO: 3554 - protein, 722 aa, H. influenzae strain 86-028NP
MTTQNFLVEIGTEELPPKALKTLATSFADNVEAELNQAGLSFDKIEWFAAPRRLAVKVLNLATQQPSKEIEKRGPAVSAAFDAEGKPTKAAEGWARGCGITVEQAERIATDKGEWLVHRTKIKGQPTKNLLNDIVANALAKLPIPKPMRWADKTVQFIRPVHTVTMLLGDELIEGEILGVASARTIRGHRFLGEKEFDIQHADQYPQLLRDKGSVVADFNERKAEILAKSQAKATALGGVADIEESLLEEVTSLVEYPNVLAAKFEERFLAVPAEALVYTMKGDQKYFPIYDKDGRLLPHFIFVSNINPEDPTAIIEGNEKVVRPRLTDAEFFFKTDLKQKLVDRLPRLETVLFQQQLGTLKDKTDRIEQLAGEIAKQIGADEAKAKRAGLLSKCDLMTNMVFEFTDTQGVMGMHYARHDGEDEEVAVALNEQYMPRFAGDELPKSLVASAVALADKFDTLTGIFGIGQAPKGSADPFALRRAALGALRIIVEKNLPLDLNDIISKAFDLYKELDNERLRNAPIAKTRGGFSEYPEGYVSFFTRGDDLVPKQKILDEVVDFMLGRFRAWYQDEGIAVDVIQAVLARRPTRPADFDARVRAVSHFRTLDSAEALAAANKRVSNILAKAGAAIGEINLTACVEPAEKALAEAVLALRTEVQPLIAQGDYTAVLDKLANLRAPVDSFFDNVMVNAEDPALRQNRLAILNTLQGLFLQVADISVLQ

SEQ ID NO: 3555 - protein, 138 aa, H. influenzae strain 86-028NP
MTLQKFLLPPLLFLSINTFAAPAYLLFGGDNHDKFLGCLNCSKHDNSSIWNKYGEFGSKYNSDSIWNKYGTYGSKYNSESPWNKYSTSGPVIVDNEGNFYGKFTTNKYDNQTRIKSLLWILENHEYIIENINDVIDKM

SEQ ID NO: 3556 - protein, 121 aa, H. influenzae strain 86-028NP
MQPYEKYLKLNSQKLRADQTDTERKLWQRINRDQLLGFRFNRQKPLLSYIVDFYCAKTKLIIELDGSQHYKPDYQEKDALRDAELNSLGFTVMRFSNDEVMREIEAVVEQIYLFLENVRTD

SEQ ID NO: 3557 - protein, 86 aa, H. influenzae strain 86-028NP
MSKPILFYAETCPDTAPFVAELDRLGVDYDEVEIMTSLPNLKQFIRLRDSSAEFDNSKANGYLGIPALLLPNGDVVLDLSKLKVIF

SEQ ID NO: 3558 - protein, 302 aa, H. influenzae strain 86-028NP
MSTKFNVKTFQGMILALQEYWANQGCTIVQPFDMEVGAGTSHPMTALRALGPEPMAFAYVQPSRRPTDGRYGENPNRLQHYYQFQVVIKPSPDNIQELYLGSLEMLGFDPTQNDIRFVEDNWENPTLGAWGLGWEVWLNGMEVTQFTYFQQVGGLECKPVTGEVTYGLERLAMYIQGVDSVYDLVWSDGPLGKTTYGDVFHQNEVEQSTYNFEHANTDFLFYCFDQYEKEAQELLALEKPLPLPAYERILKAAHSFNLLDARKAISVTERQRYILRIRALTKGVAEAYYASREALGFPGCKK

SEQ ID NO: 3559 - protein, 508 aa, H. influenzae strain 86-028NP
MSSQCPFSHLAATNLTMGNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDLVGNNTPVFFLRDPRKFPDLNKAVKRDPRTNMRSATNNWDFWTLLPEALHQVTVVMSDRGIPASYRHMHGFGSHTYSFWNEAGERFWVKFHFHTQQGIKNLTDAEAAAVIASDRESHQRDLYEAIERGDFPKWTLFVQIMPEADAEKVPYHPFDLTKVWPKKDYPLIEVGEFELNRNPENFFADVEQSAFAPSNLVPGIGASPDRMLQARLFNYADAQRYRLGVNYRQIPVNRPRCPVHSNQRDGQGRVDGNYGSLPHYEPNSFSQWQQQPDFAEPPLRINGDAAHWDYRNDDNDYFSQPRALFNLMNADQKQSLFNNTAAAMGDAPDFIKYRHIRNCHWCDAAYGEGVAKALGLTVEDALKARDTDPALGQGGLL

SEQ ID NO: 3560 - protein, 393 aa, H. influenzae strain 86-028NP
MKRVTGFPTRPNMVQQLLNVGFDYYNLPSSDGSHYWSDNVAYEFTLAEIDRIEDTTNELHSICLDFAADEIKKGDYENYHFTELQKQLVETSWRNQDPYLYGRFDFGYDGNNLKMFEYNADTPTSLLEAAIVQWQWLEQIEGLKHRDQFNWIHEELIKHFQFLKQQSGKTDFHLSAMQDAGREDWGNVDYLADVAYNAGWNIHQLAVEDIGYNSETKKFVDLNDQPIEMLFKLYPLEWLSHAEFARHITTAETRFIEPAWKMLLSNKALLAKLWARYPNHPNLLPAYFTPFELPKDLLMWVKKPLLGREGANVFYYEKNNGVEFAAKGSEHSTFYANSGYVYQQKFELPSFDGMYPIIGSWVVGDVACGMGLREDFTAVTGNDSHFIPHYFVP

SEQ ID NO: 3561 - protein, 193 aa, H. influenzae strain 86-028NP
MKKKNQILVSLSIVALLGGCSEEQVQRDVYQSLDDCLADWKKIELCEADKNTESTQKTETTPQQGLGLNIRDNGNAESAVKNPAENNVQANQSENNAESTAKAESTDPSLGAAIAGGVIGYMAARAISSFLGPSYHPGNRAVTTPTGQVVQPQTNRSVGKPMLVKGNAGSMNSKPVSRGGFSSPNNTHRSSGG

SEQ ID NO: 3562 - protein, 150 aa, H. influenzae strain 86-028NP
VFLYLIFKGKRMLHLTLEDELFLGTPKQVGTHSTVFEHFAVMFEDDGETGYFYALDMRQNAQPIVDMLHVYNVDSTSNHHEARKLEICWDESGYLALLLINGYPHAVFDFARLVGYNSNKYPQPDLMSMWTREEITNKQAEQWLGVKTIR

SEQ ID NO: 3563 - protein, 436 aa, H. influenzae strain 86-028NP
MAKIVKVIGREIIDSRGNPTVEAEVHLEGGFVGLAAAPSGASTGSREALELRDGDKSRFLGKGVLKAVAAVNNEIAQAIVGKDATNQAEIDQIMIDLDGTENKSNFGANAILAVSLANAKAAAASKGLPLYAYIAELNGTAGVYSMPLPMMNIINGGEHADNNVDIQEFMIQPVGAKTLREALRIGAEVFHNLAKVLKSKGMSTAVGDEGGFAPNLASNADALACIKEAVEKAGYVLGKDVTLAMDCASSEFYNKENGMYEMKGEGKSFTSQEFTHYLEELTKQYPIVSIEDGQDESDWEGFAYQTKVLGDRVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAAFPGLKAVKGQA

SEQ ID NO: 3564 - protein, 401 aa, H. influenzae strain 86-028NP
VSQYSENIIIGAGAAGLFCAAQLAKLGKSVTVFDNGKKIGRKILMSGGGFCNFTNLEVTPAHYLSQNPHFVKSALARYTNWDFISLVAEQGITYHEKELGQLFCDEGAEQIVEMLKSECDKYGAKILLRSEVSQVERIQNDEKVRFVLQVNSTQWQCKNLIVATGGLSMPGLGATPFGYQIAEQFGIPVIPPRASLVPFTYRETDKFLTALSGISLPVTITALCGKSFYNQLLFTHRGISGPAVLQISNYWQPTESVEIDLLPNHNVEEEINQAKQHSPKQMLKTILVRLLPKKLVELWIEQGIVQDEVSANISKVRVKNLVDFIHHWEFTPNGTEGYRTAEVTMGGVDTKVISSKTMESNQVSGLYFIGEVLDVTGWLGGYNFQWAWSSAYACALSISRQ

SEQ ID NO: 3565 - protein, 380 aa, H. influenzae strain 86-028NP
MKSLLDIFTRVQKTFVFATALLFAFSLFTQAEMVDTYQFQNQDDRTRAVELAKSLRCPQCQNQNLVESNSPIAYDLRLEVYKMVDEGKSNQQIIDKMTARFGDFVNYKPPFKWNTALLWLLPVALLILAAVLLYFSNRKKQFSEKVVAQQLENDEIISLPSTFGSSPRKQGEPSKLSKGKVNSKIYFVLFTLLIAIPATYYFSLDRFSRVQQGEQSMIEQHNQNVEMNDEHKNENVIEKLQNKLRTDPNNAETWLQLGEAYVQNNEFDSALVAYSNAEKLSGSKPNILGLAATALYYQAGQQVTPKVEQLLNEALAKDKNEVSSLSLLATIALENRQYQQAGMYLQQLLDSGNAAVDRRSVIQRMKMLDFLQRGEKGQNP

SEQ ID NO: 3566 - protein, 176 aa, H. influenzae strain 86-028NP
MNKKLLFFAPLFVLLGVCVLLIAGLNQDPKKIASALIDKPVPEFYQANLHDPSQIVSPKDFPKQPFLLNVWGSWCGYCKEEHPLLIEIAKTLPIVGVDYRDNPQNGIEILKRMGNPFILTIDDSQGELALKLGVDGAPETYLVDENGVIRYRHSGLLDKETWQTVFLPKIEALKNK

SEQ ID NO: 3567 - protein, 635 aa, H. influenzae strain 86-028NP
MLPELGFFLLLLATASAFFLALVPQFGLFKKNSTLINAAWPLSYIFTLATTFSIGLLTYSFAVDDFTLEYVAAHSNSQLPTFFKVAATWGGHEGSMLFWLFSLSLWLAAFAFFNRKNDRTFSAQSLSLLGLICFGFAVFILFYSNPFGRIFPAPAEGRDLNPMLQDVGLIFHPPLLYVGYVGFAVNFAMSLSALIYNQSARQIARSMRGWVLVSWLFLTIGIVLGAWWAYYELGWGGWWFWDPVENASLMPWLLGLALLHSLMATEKQGVFSYWTTLFSLLAFAFSVLGTFIVRSGALTSVHAFALDNTRGYVLLLIFFVLTALAFGLFALRAGSSSESAVKFQFISKSGGILLLNILLTIATVSTFLGTFYPMLFQAMNWGSISVGSPYFNSIFFPIITAILILMVIVLSIRKGQFDRTLLIRCGWLLIPSLILAGLMIWQQLRHNSALNFHAFAFVLLTLAIWLLLVTLWQNWRQIRLSQFGMILAHCGVAIVTIGAVMSGYFGSEIGVRLAPQQSQTLGQYEFHYRQFSNEIGPNFTAEVAFFDVTENGKPYAEIIPERRYYDVRTMTMSEVGLNGGFWGDLYIVMGDSLGKGEFTFRLHYKPLIRWLWAGGILMAFGALFSVFGLRRKQEK

SEQ ID NO: 3568 - protein, 270 aa, H. influenzae strain 86-028NP
MNPMLNIAIRAARKAGNVIAKNYERRDAIESTQKGINDYVTNVDKAAEAEIIEIIRKSYPDHTIITEETGAIEGKEGKDSDVQWIIDPLDGTRNFMTGLPHFSVSIAVRVKNRTEVGVVYDPIRNELFTAVRGEGAKLNEVRLRVDSKRELQGSILATGFPFKQPKLMPAQFAMMNALIEDAADFRRTGSAALDLCYVASNRIDGYFEMGLKAWDCAAGDLIVREAGGLVCDFDAGNGYLRSGNIIAAPSRVIKEMLNKIRPCLGAEFNH

SEQ ID NO: 3569 - protein, 170 aa, H. influenzae strain 86-028NP
MQKGVTLVELLIGLAIISIVLSFVVPLWQTDSPKTILAKEQHRLYLFLRQIQVRAENSSEVWFLLINRNLATQQWCLTAQVKNNQTCDCLNPINCPKEVYAHFYYPYFPNKTMIQSHHIYPKEITRFDGIRNTIVTRCFILQAENERTLFLFFNVGSIRLKTNQFDSACN

SEQ ID NO: 3570 - protein, 239 aa, H. influenzae strain 86-028NP
MMKTLLKGQTLLALMISLALSSLLLLSISHFYVQIQTQNQQMLLHLKLQAELQRILQLIGKDLRRLGFRALNAKLTESNLFLFELDEQGTAIFISQEDNAPPNSCVLFFYDLNKNGCIGKGSPKTCMKNGKNTSKSSTEELFGYKVSNKMIKTKLTYQSVIPTNCTAETCKRAFQQTACNAGGGWADLLDNNEYEITRLQFNWLIEGKGLEIKLKGNLKQTPNISYETSLVVALWNQKQ

SEQ ID NO: 3571 - protein, 227 aa, H. influenzae strain 86-028NP
MTIQKGIITLTILIFISGLLSVILLLDDSNLSFFRAQQNQRKLYVERTLQLQRITALKKQTACLDLSLNNDESVKQISITLDGATDSIQYFLWCERMSLFKKSPKKGDNQGALKDFVSGEKLAYFRPHFSSPPRILNANKTPKLYWFSDSQAEVEINGTVSAVLIAEGDLKLTGKGRISGAVITNGNLTLDGVTLAYGKKTVVALVQQYSQWKLAEKSWSDFNVQDE

SEQ ID NO: 3572 - protein, 91 aa, H. influenzae strain 86-028NP
MSLITLLFSLALFSVLFLVFNQWTAEQRKSAVKIYQDFQATQIAENQAQRQFLGLACEQLIQQNGLTFRIRCENERIIVRYPTSEILIKTQ

SEQ ID NO: 3573 - protein, 1121 aa, H. influenzae strain 86-028NP
VFIIYYSNQLEKQKEILSSLFKSLPPEDPFQQDIILVQSPNMAQWLQIELAKETGISANLKFPMPASFIWQLYAQNLPATALENPFDKDSMMWRLIRLIPTFLEKENFLPLRNYLASSPHSEQYKLYQLSSKIADLFDQYLVYRAEWIFAWEKGEDEQITAQIRKQQPNLNDTLFEQIQGNIKWQGELWRALVVDVKSDVDDATHRAALHNQFLALLADKKAPKKLPSRIFIFGIPALPTAYLNILQAISSEVDIHLFFNNPCQEYWGDISDLRLDYLRSRQRYQFNKQNENQPLFSEEQLSQLENAQFDVTYQNENLQVGNPLLAAWGKMGRDFLYTLVRDEEHIPTYPVNAYQEIKSNSLLGQLQSQILHLENKPLNIAKNDRTLTLHSCHSAMREVEVLHDYLLDLFNQDPNLTPKDVVVMVADINQYTPYIQAVFGQKNRNAPQIPFSLSDNKLSESDVLVSSYLTLLRLKESNFSAEDVLALLDIPATRERFNISLADLPLVREWVADSGIRFGLQKNQDGINFNSWQAGLERMILGYAMREEQGIWQDSLGLNSSYGLKGELAGNLSYFFTALSLLHETLQQAHSIEKWQEILTALLSDFFVQNEDTSDTIFYIQEKINELAEHLKMLHFTEKLQADVIADVITMKLEDAPNSLKFLAGKVNFCTLLPMRSVPFKVVCLLGMNDADYPRTQTPNSFDLMQYHYQKGDRVRRDDDRYLFLEALLAARNYCYISYIGRSITDNQPKEPSVLVSQLVDYINQGQKENVLTVIEHPMTAFSPDNFKYNEKFTRSFATKWLPMAQFDASASNSEFAVTMTENPEKIEEVELDSLVSFVENPVKFFFEKQLGVYFRDKDERIADSENFTLSGLDNYSLNNDLIYLDEQNFADYFRQAEVKGVLPRAEFGKVYAENIRDNVLEFKEKIADLGEPKQASIDFNIAVDWQNENQKIRLFGYMEALFGDNSQVIHWHFAKYKDRYCIRPWIYYLIQCVTQENAVPAKLITQDKVLELPPIEREVALAQLQIYVKDYLQSQIEIQLVPTVRNISDFIVSDENSVSEKLQELTESNGFGSKADPYWSRVLAQTSRFKQPENIAKLLKQTKAWFGLLFAQKKTRKAQS

SEQ ID NO: 3574 - protein, 149 aa, H. influenzae strain 86-028NP
MHCPFCDTEETKVIDSRLVSDGYQVRRRRECGHCHERFTTFEMAELIIPKIIKTDGTREPFNEDKLRSGIQHALEKRPVSADDVEKAINHIILQLRATGEREVPSKLVGKLAMNELKKLDKVAYIRFASVYLSFDDIDQFTIEIEKLKD

SEQ ID NO: 3575 - protein, 372 aa, H. influenzae strain 86-028NP
MLEFSSQDCVFMQRALDLAAKGQYTTTPNPSVGCVLVKNGEIVGEGFHFKAGQPHAERVALAQAGENAKGATAYVTLEPCSHYGRTPPCALGLIEAGVVKVIAAMQDPNPQVAGKGLKMLSDAGIESAVNLLNDQAEKINKGFLKRMRQGMPFVQLKLAMSLDGRTAMASGESKWITGPDARSDVQKMRAKSSALLSTSATVLADDPSLNVRWDEFPENLKTEYKKEWLRQPVRVILDSQHRIQPTHKLFLTHSPVWLVSSETRDLTGFPDFCEQIILPKENLLKELMRELGKRQINTLWVEAGANLAGSLIDAKLVDELIIYIAPKLLGDNARGLCQLPNLTKLADAPLWQLNELEQIGDDIKLTYTPKGV

SEQ ID NO: 3576 - protein, 340 aa, H. influenzae strain 86-028NP
MLKKLFHSALWGLAAAGVILFAVPRLNNSNIFTSDDIISFKNAVRIASPAVVNVYNRSFSSASINDNDQLQVNNLGSGVIMSKDGYILTNKHVIQNADQIVVALQNGNIFEASLVGSDDLTDLAVLKIRADNLSTIPQNSARQAHVGDVVLAIGNPYNLGQSVSQGIISAIGRNAVGDSVGRQNFIQTDASINRGNSGGALINSAGELVGISTLSIGKTANEIAEGLNFAIPIDIANDVLRKIMRDGRVIRGYFGVQSDISSSSEEGIVITDVSPNSPAAKSGIQVGDVILKLNNQEGISAREMMQIIANTKPNSKVLVTILRLGKILQIPVVIEEFPVN

SEQ ID NO: 3577 - protein, 271 aa, H. influenzae strain 86-028NP
MPELPEVETALRGISPYLKNFTIEKVVVRKPKLRWAVSEELITLKNVKIVDLTRRAKYLIIHTEKGYIIGHLGMSGSVRIVPQDSAIDKHDHIDIVVNNGKLLRYNDPRRFGAWLWTENLDDFHLFLKLGPEPLSDEFNAEYLFKKSRQKSTALKTFLMDNAVVVGVGNIYANESLFICGIHPLKLAKNLTRNQCFSLVNTIKDVLRKAIIQGGTTLKDFLQPDGRPGYFAQELLVYGNKDKPCPKCGGKIESLIIGQRNSFFCPKCQKRG

SEQ ID NO: 3578 - protein, 511 aa, H. influenzae strain 86-028NP
MSNLKQHKQALFCNDNEAINDYETAMYNAVQAVSAWLKNEKMYTGGSIKQMRALISGFNPTKEGMGVQKSLDHLVKIFLNPSLKVHHPHSLAHLHCPTMVTSQIAEVLINATNQSMDSWDQSPAGSIMEEHLINWLRQKAGYGEGTSGVFTSGGTQSNLMGVLLARDWAIANHWKNEDGSEWSVQRDGIPAEAMQKVKVICSENAHFSVQKNMAMMGMGFQSVVTVPSNANAQMDLIALKQTLAQLKADGKITACIVATAGTTDAGAIDDLKAIRKLADEYQAWLHVDAAWGGALLLSKDYRYFLDGIELTDSITLDFHKHFFQTISCGAFLLKDPENYRFINYKADYLNSEYDEAHGVPNLVAKSLQTTRRFDALKLWFTLEALGEDLYASMIDHGVKLTKEVEQYINDTPALEMLVPSQFASVLFRVVPKDYPAEFIDALNQNVADELFARGEANIGVTKVGDKQSLKMTTLSPIATLENVKALLTQVLTEANRIKDDIKNGTYTPPID

SEQ ID NO: 3579 - protein, 132 aa, H. influenzae strain 86-028NP
VLKYMLDTNIVIYVIKRRPLEILSRFNQNAGKMCVSSITVAELYYGAEKSEYPERNIAVIEDFLSRLTILDYQPKHAAHFGNIKAELSKQGKLIGENDIHIAAHARSEGLILVSNNLREFERVIALRTENWV

SEQ ID NO: 3580 - protein, 77 aa, H. influenzae strain 86-028NP
MIEASVFMTNRSQAVRLPAEVRFSEEIKKLSVRVSGSDRILSPLNQSWDSFFLNDQAVSDDFMNEREIAFQPEREAL

SEQ ID NO: 3581 - protein, 454 aa, H. influenzae strain 86-028NP
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEHYFENFIEDVESGVVKPAAVILEAIQGEGGVVPAPISFLQKVREVTQKHGILMIVDEVQAGFCRSGRMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQAKDAIGAYPRDCELAAAIQKACFKNKLLLERGGRGGNVVRVLCAVNINQSECEEFIKRFKQSVVDALKVVRS

SEQ ID NO: 3582 - protein, 56 aa, H. influenzae strain 86-028NP
MAAKGAREKIRLVSTAETGHFYTTDKNKRNMPEKMEIKKFDPVVRKHVIYKEAKIK

SEQ ID NO: 3583 - protein, 78 aa, H. influenzae strain 86-028NP
MSRVCQVTGKRPAVGNNRSHAMNATRRRFLPNLHTHRFWVESENRFVTLRLTAKGMRIIDKKGIDAVLAEIRARGEKI

SEQ ID NO: 3584 - protein, 234 aa, H. influenzae strain 86-028NP
VRSKSFLFFFYKYMENNDELMPREKLLAFGAKALSDYELLAIFLRTGIKDCPVMSLSKNVLTHFGSLHALLSADKKAFCSVKGLGITQFIQLQAITEMTKRYLKQEMLSTPIINDLETVKLFLLTELQHEEREVFMVLFLDNQHRLIKKERLFLGTINVSAVYPREIIKEALYCNAAALILAHNHPSGITEPSYSDQLITKKIQDAAELMEIRVLDHLIVGKSDCYSFAENCLL

SEQ ID NO: 3585 - protein, 400 aa, H. influenzae strain 86-028NP
MNLNGKRVVVGITGGIAAYKTIELIRLLRKAEAEVRVVLTPAAAEFVTPLTLQAISGNAVSQSLLDPQAELAMGHIELAKWADAIIIAPASADFIARLTVGMANDLLSTICLATDAPIFLVPAMNQQMYHQSITQQNLTTLQTRGIELIGPNSGFQACGDMGKGRMSEPEEIFTALSDFFSQKQDLQGLNVAITAGPTREAIDPVRYISNHSSGKMGFAIAEAFAKRGANVTLISGPVNLTTPKNVNRINVISAQEMWQASLESAVKNQIFIGCAAVADYRVAEVAEQKIKKSGDEISIKLIKNPDIISDVGHLKTHRPFTVGFAAETQNIDDYAKDKLERKNLDMICANDVSGGQVFNADENALQLFWKNGHKKLSLKSKVELAADLVNEIIERYQKTL

SEQ ID NO: 3586 - protein, 151 aa, H. influenzae strain 86-028NP
MKKIDVKILDSRIGNEFPLPTYATEGSAGLDLRALIDESFEIQPGETKLIPTGLSIYIADPNLAAVILPRSGLGHKHGIVLGNLVGLIDSDYQGPLMVSMWNRGNEPFKIEVGDRIAQLVFVPVVQAEFNIVEDFQQTERGEGGFGHSGKQ

SEQ ID NO: 3587 - protein, 218 aa, H. influenzae strain 86-028NP
MVEEQLSLSGVEEIAPKIETPKIEKRTVKERRQQVLTVLIHMLHSERGMERMTTARLAKEVGVSEAALYRYFPSKTKMFEALIEHIESTLLSRITASMRNETQTMNRIHDILQTILDFARKNPGLTRVLTGHALMFEEAQLQARVAQFFDRLEMQFVNILQMRKLREGRAFNVDERIIASHLVTLCEGQFMRYVRTNFRLNSSQSFEQQWRFIEPLFA

SEQ ID NO: 3588 - protein, 83 aa, H. influenzae strain 86-028NP
MIIPWQELEAETLDNIVESVILREGTDYGIEELSLNQKKQLLLTQIRNGIALIVWSELHESIDIKNKTEFLKQECKEQECQMN

SEQ ID NO: 3589 - protein, 224 aa, H. influenzae strain 86-028NP
MSNELTEIDEVVTSSQEEATQRDPVLDWFLTHCHLHKYPAKSTLIHAGEDATTLYYVIKGSVMVSSKDDEGKEMILTYLGAGQFFGEAGLFDEGSKRSAWVKTKTTCEIAEISYKKYRQLIQANPEILMFLTAQLARRLQNTSRQVTNLAFLDVAGRIAQTLMNLAKQPEAMTHPDGMQIKITRQEIGQMVGCSRETVGRIIKMLEDQNLIHAHGKTIVVYGAR

SEQ ID NO: 3590 - protein, 392 aa, H. influenzae strain 86-028NP
MIDCRYYQQNECRSCQWLEIPYSQQLAEKQHHLKQQLISINCDKAQWLAPFQSNEQCFRNKAKMLVSGSVERPILGILKNPNDPQSAIDLCDCPLYPARFSIIFSILKDFIGRAGLVPYNIAKQKGELKYILLTESIATGKLMLRFVLRTENKLPLIRRELPKLLEKLPHLEVVSVNLQPLHAAILEGEQEIFLTEQQFLPENFNSIPLFIRPQGFFQTNPKVAEGLYATAQQWVSELPIYNLWDLFCGVGGFGLHCAKALQEKWGKPIKLTGIEISSSAILAASHSAKILGLEHVNFQSLDAASVIENKNENKPDLVIVNPPRRGIGKELSEFLNQIQPHFILYSSCNAMTMGKDLQHLTCYKPLKIQLFDMFPQTSHYEVLVLLERKKIN

SEQ ID NO: 3591 - protein, 351 aa, H. influenzae strain 86-028NP
MSTLLIDLKGKELEQEEVELLSHPLVAGLILFTRNFEDREQIQELIRSVRQRVKKPLLITVDQEGGRVQRFRDGFTMLPSMQAFQETLSATEQVSFAKEAGWQMAAEMIALDIDLSFAPVLDLGHECRAIGDRSFSSDVKSAVNLAINFIDGMHQAGMASTGKHFPGHGHVLADSHLETPYDDRAKDEIFGYDLQPFQQLISQNKLDAIMPAHVIYGQCDSQPASGSEYWLKEILRKKLNFQGTIFSDDLGMKGAGVMGNFVERSKKALNAGCDLLLLCNEREGVIQVLDNLKLTENEPHFMARQARLKNLFKRSVIEWNDLVLDQRWKLNHRNLADIQSRWLDIQAAKND

SEQ ID NO: 3592 - protein, 116 aa, H. influenzae strain 86-028NP
MKKYFLILASFMLAACSISEQNLTYSTKPILNITSSLSPLIQVETTQKSAVIKNKSQQLLNVSYHLYWYDHLGVTQIWENQQESYSAQFSLKPQEEKSIDLIKPTVESKNYRLYLK

SEQ ID NO: 3593 - protein, 130 aa, H. influenzae strain 86-028NP
MDRLIRRTFYREQTMAEETIFSKIIRKEIPANIVYQDELVTAFRDISPQAKTHILIIPNKVIPTVNDVTEQDEVALGRLFSVAAKLAKEEGIAEDGYRLIVNCNKYGGQEVFHLHMHLVGGEPLGKMLAK

SEQ ID NO: 3594 - protein, 941 aa, H. influenzae strain 86-028NP
MTVDYKNTLNLPETSFPMRGDLAKREPDMLKNWYEKNLYQKIRKASKGKKSFILHDGPPYANGNIHIGHAVNKILKDIIIKSKTALGFDSPYIPGWDCHGLPIELKVEGLVGKPNEKISAAEFRQKCREYASEQVEGQKKDFIRLGVLGDWDNPYLTMNFDTEANIIRTLGKVIENGHLYKGSKPVHWCLDCGSSLAEAEVEYEDKVSPSIYVRFPAESAVEIEAKFSAQGRGQGKLSAIIWTTTPWTMPSNRAIAVNADLEYNLVQLGDERVILAAELVESVAKAVGVEQVEILGSVKGADLELSRFHHPFYDFTVPVILGDHVTTDGGTGLVHTAPDHGLDDFIVGKQYDLPMAGLVSNDGKFISTTEFFAGKGVFEANPLVIEKLQEVGNLLKVEKIKHSYPHCWRHKTPIIFRATPQWFIGMETQGLRQQALGEIKQVRWIPDWGQARIEKMVENRPDWCISRQRTWGVPMTLFVHKETEELHPRTLELLEEVAKRVERAGIQAWWDLDEKELLGADAETYRKVPDTLDVWFDSGSTYSSVVANRLEFNGQDIDMYLEGSDQHRGWFMSSLMLSTATNSKAPYKQVLTHGFTVDGQGRKMSKSIGNIVTPQEVMDKFGGDILRLWVASTDYTGEMTVSDEILKRAADSYRRIRNTARFLLANLNGFDPKRDLVKPEEMISLDRWAVACALDAQNEIKDAYDNYQFHTVVQRLMRFCSVEMGSFYLDIIKDRQYTTKADSLARRSCQTALWHIAEALVRWMAPILSFTADEIWQHLPQTESARAEFVFTEEFYQGLFGLGEDEKLDDAYWQQLIKVRSEVNRVLEISRNNKEIGGGLEAEVTVYANDEYRALLAQLGNELRFVLITSKVDVKSLSEKPADLADSELEGIAVSVTRSNAEKCPRCWHYSDEIGVSPGHPTLCARCVENVVGNGEVRYFA

SEQ ID NO: 3595 - protein, 312 aa, H. influenzae strain 86-028NP
MDKDMQLIRGLHNANRVLQGCALTIGNFDGVHLGHQTVLRHLRQKADELNLPMAVLLFESQPREYFMGENAPARLMRLRDKIYYLEKAKVDVVIVAKFDRTFAEQPADVFIEQTLVNHLHVKFLSIGDDFKFGSKRQGNFAMLQAASKRFGFIVEDNRSFCLDAQRISSTAIREALANDDLQLAENLLGKPYRIFGRVIHGNKLGRTIGFPTANIRLHRQVNPIKGVYAVKVRLKSGEIFNGVANMGKRPTINGLMQLLEVHLFDFSQNIYGQMVEVEFCHKIRNEIKFPSFDDLKVQIEKDVETAKAFFNS

SEQ ID NO: 3596 - protein, 510 aa, H. influenzae strain 86-028NP
MTLLSRVLGLVRDVVIAHLIGAGAAADVFLFANRIPNFLRRLFAEGAFSQAFVPVLAEYQKSGDMNKTREFIGKVSGTLGGLVSIVTILAMVGSPVVAALFGMGWFTDWMNDGPDAHKFEQASLLLKITFPYLWFVTFVALFGAVLNTIGKFGVMSFSPVLLNIAMIATALFLAPQMDNPDLALAIGIFLGGLLQFLFQIPFMKQAGLLVKPKWAWRDEGVTKIRKLMIPALFGVSVSQINLLLDTVIASFLMTGSISWLYYSDRLLEFPLGLFGIAISTVILPTLARHHVNREGDSAKSAVDFRNTMDWGVRMIFLLGVPAAIGIAVLAQPMLLTLFMRGNFMLNDVYAASYSLWAFNAGLLSFMLIKILANGYYARQDTKTPVKIGIIAMVSNMGFNLLAIPFSYVGLAIASAMSATLNAYLLYRGLAKADVYHFSRKSAVFFVKVLLAAIAMGAAVWYYVPEINQWAKMDFFMRVYWLVWLIVLAAIVYGTTLILLGVRKHHLLTKN

SEQ ID NO: 3597 - protein, 89 aa, H. influenzae strain 86-028NP
LTLANIKSAKKRAVQSEKRRQHNASQRSMMRTYIKKVYAQVAAGEKSAAESAFVEMQKVVDRMASKGLIHANKAANHKSKLAAQIKKLA

SEQ ID NO: 3598 - protein, 188 aa, H. influenzae strain 86-028NP
VKLIATLGMAALLSGCSMFDSQQSAIPAEFAGADYQLSDQHAKQWAIASKQVEQCVYPNLTRILQQHFSKEDSYIHSQYVFFYPLEKIIGEQYVKIIQADEKSMNYASYQFKKFRTKVSNVEPLTKQSCLKLRNEAHDDLAVVKGQYKNGMVEVQKNEDGTPKNSDGIATNQNKFFFDIIKWGSMLLL

SEQ ID NO: 3599 - protein, 285 aa, H. influenzae strain 86-028NP
MQNPKDDVLYAPVEWVDHSEGYSDIRYHKSTDGIAKITINRPEVRNAFRPQTVKEMITAFSDARFDENIGVIVLTGEGEKAFCSGGDQKVRGNYGGYKDDSGVHHLNVLDFQRDIRSCPKPVVAMVAGYAIGGGHVLHMLCDLTIAAENAIFGQTGPKVGSFDGGWGASYMARLVGQKKAREIWFLCRQYNAQEALDMGLVNTVVPYADLEKETVRWCREMLRNSPIAIRCLKAALNADCDGQAGLQELAGNATMLFYMTEEGQEGRNAFNEKRAPDFSKFRRNP

SEQ ID NO: 3600 - protein, 329 aa, H. influenzae strain 86-028NP
MAQKSFNLYRYSIPVDSQLILRDRFLKRREGLIVRVSCSRDGWGEIAPLPGFSEETLDQTQEQAIEWLTTWCNASCDAPRVPLDGTYPSVAFGISCAMDEMKGYLQAEGNYHTAPLCCGDPDELYAKLASMEGEKVAKMKVGIYEANRDGLIADMFLEAIPDLQLRLDANRHWSLEKALQFAAKVKPQHRKRIQFLEEPCKTQELSREFAAQTDIAIAWDESVREPNFCLEKEPHLSAVVIKPTLIGSIQRCTELINQAHSLGLKAVISSSIESSLGLSQLARIAQQYTPNVTPGLDTLDLMEYQVLRAWPNSNLPIVNLESEFITKII

SEQ ID NO: 3601 - protein, 149 aa, H. influenzae strain 86-028NP
MSQTHRILLLNGPNLNMLGAREPKHYGSISLASIEEKIQTLATQHNVKVECFQANSEEKLINKIHESFQQVDFILINPAAYTHTSVALRDALLAVSIPFVEIHLSNVHKREPFRHHSYFSDVAEGVICGLGAKGYEFAFLFAIDYLAKK

SEQ ID NO: 3602 - protein, 155 aa, H. influenzae strain 86-028NP
MDIRKIKKLIELVEESGITELEVQEEEGTVRISRATPVVAPAAVQYAAAPVVAPTPAAAPAQAPAAATPAPAASDELSGHLVRSPMVGTFYRSPSPEAKAFVEVGQSVKVGDALCIVEAMKMMNRIEADKAGVVKAILINDGDAVEFDEPLIVIE

SEQ ID NO: 3603 - protein, 448 aa, H. influenzae strain 86-028NP
MLEKVVIANRGEIALRILRACKELGIKTVAVHSTADRDLKHVLLADETVCIGPAPSAKSYLNIPAIIAAAEVTGADAIHPGYGFLSENADFAEQVERSGFTFIGPTADVIRLMGDKVSAIKAMKKAGVPCVPGSDGPVGNDIAKNKEIAKRIGYPIIIKASGGGGGRGMRVVRSEDALEESIAMTKAEAKAAFNNDMVYMEKYLENPRHVEIQVLSDTHGNAVYLAERDCSMQRRHQKVVEEAPAPGITEEVRRDIGSRCAKACVEIGYRGAGTFEFLYENGEFYFIEMNTRIQVEHPVTEMITGVDLVKEQLRIAAGLPISFKQEDIKVKGHAMECRINAEDPKTFLPSPGKINHLHSPGGLGVRWDSHVYGGYTVPPHYDSMIAKLITYGDTREIAIRRMQNALSETIIDGIKTNIPLHELILEDENFQKGGTNIHYLEKKLGMNE

SEQ ID NO: 3604 - protein, 85 aa, H. influenzae strain 86-028NP
MTLKQRYQQAGKEASWALGLSILYVIGWCLCAYLPKETQGPIGFPLWFELSCIYLPILFIVIGYWIIKIIFQDISLEINDQESQK

SEQ ID NO: 3605 - protein, 484 aa, H. influenzae strain 86-028NP
MNLGIILPLIIYLTFVFGAAIFAYVKRTKGDFLTEYYVGNRSMTGFVLAMTTASTYASASSFVGGPGAAYKYGLGWVLLAMIQVPAVWLALGALGKKFALLSRETNALTINDLFFYRYKNKYLVWLSSLALLLAFFAAMNVQFIGGARLLETTIGISYTQALLLFALTVGIYTFIGGFRAVVLTDTIQGTVMIFGTIILLVGTIYALGGVESAVNKLTEIDPDLVTPYGPNGMLDFQFMASFWILVCFGVVGLPHTAVRCMAFKDSKALHRGMLIGTIVLSIIMLGMHLAGALGRAVIPNLTVSDQVIPTLMLKVLPPIVAGIFLAAPMSAIMSTIDAQLIQSSSIFVKDLYLSTKPEAAKNEKKVSYFSSIITLILTALLIFAALNPPDMIIWLNLFAFGGLEAAFLWVIVLGIYWDKANAYGALSSMIIGLGSYILLTQLGVKLFNFHQIVPSLAFGLIAFLVGNKLGERRIEKTQLKATAL

SEQ ID NO: 3606 - protein, 290 aa, H. influenzae strain 86-028NP
MLYQILALLIWSSSLIVGKLTYSMMDPVLVVQVRLIIAMILVMPLFLRRWKKIDKPMRKQLWWLAFFNYTAVFLLQFIGLKYTSASSAVTMIGLEPLLVIFVGHFFFKDKAKWFHWLFGAMAFIGVAILINGGKNNEGIDNVSLLGCLLVLSAGIIFATVLRWTRRVVAKVSTQVYTSISIVLGVITTLPFTLLLTENWQISLNSTGIVGLLYLALGCSWLAYWLWHKGLNTVDANISGILLALEPLFGILFAVSLLGETLSFSAVLGITIIMLATLGSILLPKLLKKSV

SEQ ID NO: 3607 - protein, 295 aa, H. influenzae strain 86-028NP
MAWIQIRLNSTNEKAEQISDFLEEIGSVSVTFMDSQDTPIFEPLPGETRLWGNTDVIALFDAETDMAEIVRLLKEAKHLDSNTAYKIEQIEDKDWEREWMDNFHPMQFGKRLWICPSWRDVPDKNAVNVMLDPGLAFGTGTHPTTALCLEWLDSLDLKNKTVIDFGCGSGILAIAALKLGAKSAVGIDIDPQAILASRDNAEQNGVVDRLQLFLSDEKPSDLKADVVVANILAGPLKELYPIISQLVKPNGNLGLSGILETQAQSVCDAYTQTFALEPVAVREEWCRITGNLKTL

SEQ ID NO: 3608 - protein, 326 aa, H. influenzae strain 86-028NP
MRIGSYQLKNRVLLAPMAGITDQPFRRLCAYYGAGLTFSEMMSTNPQVWHTEKSKLRLAYSDDLGLNAVQIAGSDPLEMAQAAAINVEYGAQIIDINMGCPAKKVNRKLAGSALLQYPDLVEKILREVVAAVNVPVTLKIRTGWDKSNRNCVQIGKIAEQCGIQALTVHGRTRACLFEGKAEYDNIKAVKQAIVIPVIANGDIDSARKAKFVLDYTGADAIMIGRAALGNPWLFQAVENLIEHNSISQMPSLNEKCGQILRHIQELHQFYGEQKGYRITRKHVAWYLQGIQPDSVFKQTFNAISDPKEQLIVLEDFFNLILDKEKC

SEQ ID NO: 3609 - protein, 99 aa, H. influenzae strain 86-028NP
MLEQQRNPADALTVSVLNAQSQVTSKPLRDSVKQALRNYLAQLDGQDVNDLYELVLAEVEHPMLDMIMQYTRGNQTRAANMLGINRGTLRKKLKKYGMG

SEQ ID NO: 3610 - protein, 161 aa, H. influenzae strain 86-028NP
MTKKKVKPNSNTIALNKRARHDYFIEDEIEAGLELQGWEVKSMRAGKANISDSYVIFKNGEAFLFGASIQPLNVASTHIVCDPTRTRKLLLNKRELASLFGKANRDGFTIVALSLYWKSAWAKVKIGLAKGKKQQDKRDDIKEREWKVTKDRIMKNAHRRS

SEQ ID NO: 3611 - protein, 321 aa, H. influenzae strain 86-028NP
MIKKIAVLTSGGDAPGMNAAIRGVVRSALAEGLEVFGIYDGYQGLYNNKIKQLNRYSVSDVINRGGTFLGSARFPEFKDPNVRAKCAEILRSHGIDALVVIGGDGSYMGAKLLTEEHGFPCVGLPGTIDNDVAGTDYTIGYQTALQTAVDAIDRLRDTSSSHQRISIVEIMGRHCSDLTISAGIAGGCEYIVASEIEFNREELIQQIERSIIRGKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 3612 - protein, 193 aa, H. influenzae strain 86-028NP
MNKIFVILTALILSGCATKLTQLNVPTQLEYNGKHYVLTGSQDLGTIARYAYISKPDTLENWQSEIEILFDRNQSERSIKERIALRERIYRNTDVKDFHFDTIPENSTNPNELNGYVIYSPTKENPSWQVNVMKGRQLPQCGFVQFQYSQKIQQPTHSKHLSVDKVQQHLQKYIVDIERKHLQNLKWQLFCEK

SEQ ID NO: 3613 - protein, 283 aa, H. influenzae strain 86-028NP
MAYINAFNVNFYAKIRPFFFHKRTIMLAIISPAKTLDFESAVKNFPVFQPHFTDYSEQLIEVCRKLSPQDLSSLMSISDKLAGLNVARFAEWTKIHNEDNSRPALFAFKGDVYTGLDADSLSEDDVIFAQSHLRMLSGLYGLLKPLDLMQPYRLEMGTKLANPKGKDLYAFWGNVITQAVQQAIDAQGDNVLVNLASDEYYKSVKENQLNAKIIKPVFLDNKNGKYKVISFYAKKARGLMCRYLIQNRLTDIEQLKEFDLGGYWFDSASSTETEFVFKRDINE

SEQ ID NO: 3614 - protein, 373 aa, H. influenzae strain 86-028NP
MNDITYTLLRLMQVPKLGGVGIDKILSNITLNELLNYDDVAFRQMGWGAIQIRRWFKPEAKFIEPALAWSQKEGNHLVNYFSPFYPFLLKQTANFPPLLFVKGNLTALSQRQMAMVGSRYCTTYGEYWAKHFATELSLAGFTITSGLALGIDGHCHQAVVNIQGQTIAVLGSGLEQIYPSKHQRLSAQIIENNGALVSEFLPNQAPIAANFPRRNRIISGLSVGTLVVEATEKSGSLITARYALEQNREVFAVPGNIQNESSQGCHRLIKQGAMLVENAKDILETLYQHSIHSQTEIDFDQIAVPNYTPPPDPRRLVEAPSHPKLYSRIGYTPVSIDDLAEEFNLSVDVLLVQLLDLELQDLIISENGLYKRI

SEQ ID NO: 3615 - protein, 515 aa, H. influenzae strain 86-028NP
MTDRVIIFDTTLRDGEQALKASLTVKEKLQIALALERLGVDVMEVGFPVSSQGDFESVQTIARHIKNARVAALSRAVDKDIDAAYQALKVAEAFRIHTFIASSALHVEAKLKRSFDDVVGMAVAAVKRARNYTDDVEFSCEDAGRTGIDNICRIVEAAINAGATTVNIPDTVGFCLPNEYGNIIAQVRNRVPNIDKAVISVHCHNDLGMATANSLTAVQNGARQIECTINGIGERAGNTSLEEVVMAMKVRQDFMGVDTRINTQEIHRVSQMVSQLCNMPIQPNKAIVGSNAFAHSSGIHQDGMLKNKNTYEIMSPETIGLKKEKLNLTARSGRAAVKGHMADMGYNEQDYDLDKLYDAFLKLADKKGQVFDYDLEALAFIDMQQGDEDRLVLDKLSAHSTKEYPATAFVQLKLDGEKLSTSSIGGNGPVDAVYNAILNLTGLEIKMSHYNLTAKGEGAEALGQVDIVVEHKGRKFHGVGLATDIVESSALALVHAINAIYRAHKVADIKSHKHH

SEQ ID NO: 3616 - protein, 358 aa, H. influenzae strain 86-028NP
MQSYNVAVLAGDGIGPEVMAEAMKVLNKVQEKFGFKLNFNEFFVGGAAIDHCGYPLPAETLKGCDEADAILFGSVGGPKWTNLPPDQQPERGALLPLRKHFKLFCNLRPATLYKGLEKFCPLRADIAAKGFDMVVVRELTGGIYFGQPKGREGEGSQTKAFDTEVYYKYEIERIARAAFEAAMKRNKKVTSVDKANVLQSSILWRETVTEMAKDYPEVTLEHIYIDNATMQLIKAPESFDVLLCSNIFGDIISDEAAMITGSMGMLPSASLNEAGFGLYEPAGGSAPDIAGKGIANPIAQILSAAMMLRYSFNLNEAADAIESAVQKVLASGHRTADLADDSTPVSTAEMGTLITQAI

SEQ ID NO: 3617 - protein, 469 aa, H. influenzae strain 86-028NP
MAKTLYEKLFDSHIVYEAEGETPILYINRHLIHEVTSPQAFDGLRVANRQVRQVNKTFGTMDHSISTQVRDVNKLEGQAKIQVLELDKNTKATGIKLFDITTKEQGIVHVMGPEQGLTLPGMTIVCGDSHTATHGAFGALAFGIGTSEVEHVLATQTLKQARAKSMKIEVRGKVASGITAKDIILAIIGKTTMAGGTGHVVEFCGEAIRDLSMEGRMTVCNMAIEMGAKAGLIAPDETTFAYLKDRPHAPKGKDWDDAVAYWKTLKSDDDAQFDTVVTLEAKDIAPQVTWGTNPGQVISVNETIPNPQEMADPVQRASAEKALHYIGLEAGTNLKDIKVDQVFIGSCTNSRIEDLRAAAAVMKGRKKADNVKRILVVPGSGLVKEQAEKEGLDKIFIAAGAEWRNPGCSMCLGMNDDRLGEWERCASTSNRNFEGRQGRNGRTHLVSPAMAAAAGMFGKFVDIREVALN

SEQ ID NO: 3618 - protein, 200 aa, H. influenzae strain 86-028NP
MAGFKQLSGLVVPLDAANVDTDAIIPKQFLQAITRVGFGKHLFHEWRYLDVDGTKPNPEFVLNYPQYQGATILLARKNLGCGSSREHAPWALADYGFKVMIAPSFADIFYNNSLNNHMLPIRLSEEEVEEIFQWVWANDGKQIHVDLEAMTVTVGDKVYHFELDEFRRHCLLNGLDNIGLTLQHEEKISAYEKNIPAFLR

SEQ ID NO: 3619 - protein, 1794 aa, H. influenzae strain 86-028NP; identical to SEQ ID NO: 763

SEQ ID NO: 3620 - protein, 359 aa, H. influenzae strain 86-028NP
MAISRLLVEKFRNLTAVDLDFDPCFNFLIGNNGSGKTSLLEAIFYLGHGRSFKSAVTNRIISYDEPHFTLFGQIQESQHQWSVGLQKLRQGNTLVKINGEDGNKISDLAHLLPMQLITPEGLTLLNGGPSYRRAFLDWGLFHHQTSFYSAWSNLNRLLKQRNAALAQNQPYSAIKIWDVELAKLAHQVSQWRAEYAEALRPEIEQTCQLFLPELEINVSFHQGWEKNADYYEILQQNFERDRALNYTFSGPQKADFRFKAQGLPVEDVLSRGQLKLLMCVLRLAQGEHLMKEKQRHCIFLIDDFASELDQYKRALLAERLQQSGSQVFVTAITQRQLKEMQVENKKMFSVHNGIINALN

SEQ ID NO: 3621 - protein, 366 aa, H. influenzae strain 86-028NP
MQFSISRENLLKPLQQVCGVLSNRPNIPVLNNVLLQIEDNRLTITGTDLEVELSSQTQLSSSSENGTFTIPAKKFLDICRTLSDDSEITVTFEQDRALVQSGRSRFTLTTQPAEEYPNLTDWQSEVDFQLPQNTLRRLIEATQFSMANQDARYFLNGMKFETEGNLLRTVATDGHRLAVCTISLEQELQNHSVILPRKGVLELVRLLETNDEPARLQIGTNNLRVHLKNTVFTSKLIDGRFPDYRRVLPRNATKTVEGNWEMLKQAFVRASILSNERARSVRLSLKENQLKITASNTEHEEAEEIVDVNYNGEELEVGFNVTYILDVLNALKCNQVRMRLTDAFSSCLIENCEDSSCEYVIMPMRL

SEQ ID NO: 3622 - protein, 454 aa, H. influenzae strain 86-028NP
VNLSNLWQSCLLQLQDQVSASDLSTWLRPLQADVVADNHIVLYASNMFVKGWVETHYLAQIQQICQTLTQNPELRISLKEGVKPAPKVVENTPNISLRSESAVDFQAESSASVKFESHLNTKHLFDNFVEGKSNQLARAVGQKLAQAPGEPSANPFFLYGGTGLGKTHLLHAIGNGILADKPNARVLYIHANNFMQHMVKAVRDNKMDQFKKFYRSLDALLVDDIQFFAEKEKTQEEFFHIFNNLFETGRQIILTSDRYPKEIEKIEERLKSRFGWGLTTAIEPPDLETRVAILLKKAEEHNMNLPEEVAFFIAQRLRTNVRELEGALNRVKAMQDFKGGDIDIDFVRDTLKDILALQERLVTIENIQKVVAEYYRIKVSDLKSKSRARSVTRPRQIAMALAKELTNRSLPEIGRAFDRDHTTVLNACREVPKFREQDNSIQEDWANLIRTLSA

SEQ ID NO: 3623 - protein, 912 aa, H. influenzae strain 86-028NP; identical to SEQ ID NO: 747

SEQ ID NO: 3624 - protein, 630 aa, H. influenzae strain 86-028NP
MKSVPLITGGLSFLLSACSGGGGSFDVDDVSNPSSSKPRYQDDTSSSRTKSNLEKLSIPSLGGGMKLVAQNLSGNKEPSFLNENGYISYFSSPSTIEDDVKNVKTENKIHTNPIGLEPNRALQDPNLQKYVYSGLYYIENWKDFSKLATEKKAYSGHYGYAFYYGNKTATDLPVSGVATYKGTWDFITATKYGQNYSLFSNARGQAYFRRSATRGDIDLENNSKNGDIGLISEFSADFGTKKLTGQLSYTKRKTDIQQYEKEKLYDIDAHIYSNRFRGKVTPTKSTSDEHPFTSEGTLEGGFYGPNAEELGGKFLARDKRVFGVFSAKETPETEKEKLSKETLIDGKLITFSTKTADATTSTTASTTADVKTDEKNFTTKDISSFGEADYLLIDNYPVPLFPEGDTDDFVTSKHHDIGNKTYKVEACCKNLSYVKFGMYYEDKEKKNTNQTGQYHQFLLGLRTPSSQIPVTGNVKYLGSWFGYIGDDKTSYSTTGNKQQDKNAPAEFDVNFDNKTLTGKLKRADSQNTVFNIEATFKNGSNAFEGKATANVVIDPKNTQATSKVNFTTTVNGAFYGPHATELGGYFTYNGNNPTATNSESSSTVPSPPNSPNARAAVVFGAKRQVEKTNK

SEQ ID NO: 3625 - protein, 486 aa, H. influenzae strain 86-028NP
MKNGVKQISFLSLIGLSLIGLSLTNIAWAKVARPKNDTLTNTIQSAELKTSSFSSMPKKEIPNRHIISLSKSQLAQHPRLVLRGLILALYQNNTQAVQLLLPLYKQFPQHDNFLLTWAKAIDAREQGDLTQSIAYYRELFALDASLLPLRYQLAQALFFNYENESAKIQFEKLRTEVDDEKFLGVIDQYLLTLNQRNQWIWQVGLNFLNDDNLNNAPKSGTKIGSWTAWEKESGKGGRVFFISRKKWPWADHFFSKTMFNGNGKYYWDNKKYNEATLRIGGGLGYQTALVEVSLFPFQEKRWYAGGSSGTNTMKQYADKLGIRLENVDWLSKTWQISTALEYGESRYKIRKHLDGNYYFISSTLFYLPKSTQFWFVGMDFHRENTQALDNAYQQKTLRLGWGQDWSYGISSRLTFSYANRVYREKDLIGIQQKNREYATTITLWHRNIHFMGLTPKLSWDYQKSTSNHAFYRYDKNRIYLEIGKIF

SEQ ID NO: 3626 - protein, 44 aa, H. influenzae strain 86-028NP
MKRTFQPSVLKRSRTHGFRARMATKNGRQVLARRRAKGRKSLSA

SEQ ID NO: 3627 - protein, 119 aa, H. influenzae strain 86-028NP
VVKLNFSRELRLLTPIQFKNVFEQPFRASTPEITILARKNNLEHPRLGLTVAKKHLKRAHERNRIKRLVRESFRLSQHRLPAYDFVFVAKNGIGKLDNSAFAQILEKLWQRHIRLAQKS

SEQ ID NO: 3628 - protein, 86 aa, H. influenzae strain 86-028NP
MAETHSLGTKILIKIIRLYQIMISPFIGARCRFVPTCSCYGIEALKTHGLLKGGWLTLKRVLKCHPLNAGGFDPVPPKTNNNDEKK

SEQ ID NO: 3629 - protein, 541 aa, H. influenzae strain 86-028NP
MDSRRSLLVLALIFISFLVYQQWQLDKNPPVQTEQTTSITATSDVPASSPSNSQAIADSQTRGRIITLENDVFRLKIDTLGGDVISSELLKYDAELDSKTPFELLKDTKEHIYIAQSGLIGKNGIDTRSGRAQYQIEGDNFKLAEGQESLSVPLLFEKDGVTYQKIFVLKRGSYDLGVDYKIDNQSGQAIEVEPYGQLKHSIIESSGNVAMPTYTGGAYSSSETNYKKYSFADMQDNNLSIDTKAGWVAVLQHYFVSAWIPNQDVNNQLYTITDSKNNVASIGYRGPVVTIPAGSQETITSSLWTGPKLQNQMATVANNLDLTVDYGWAWFIAKPLFWLLTFIQGIVSNWGLAIICVTIVVKAILYPLTKAQYTSMAKMRILQPKMQEMRERFGDDRQRMSQEMMKLYKEEKVNPLGGCLPILLQMPIFIALYWTFLEAVELRHAPFFGWIQDLSAQDPYYILPILMGISMFLLQKMSPTPVTDPTQQKVMNFMPLVFMFFFLWFPSGLVLYWLVSNLITIAQQQLIYRGLEKKGLHSRKK

SEQ ID NO: 3630 - protein, 452 aa, H. influenzae strain 86-028NP
MKETIVAQATAPGRGGIGILRVSGPLATKVAQAILGKCPKPRMADYLPFKDADGTILDQGIALYFKSPNSFTGEDVLELQGHGGQVVLDLLLKRILQIDGIRLARPGEFSEQAFLNDKLDLAQAEAIADLIDATSEQAARSALKSLQGEFSKKVNELVDSVIYLRTYVEASIDFPDEEIDFLADGKIEANLRGIINQLENVRSEAKQGSILREGMKVVIAGRPNAGKSSLLNALAGREAAIVTDIAGTTRDVLREHIHIDGMPLHIIDTAGLRDATDEVERIGISRAWTEIEQADRIILMLDSSDPESADLSKVRSEFLAKLPSTLPVTIVRNKIDLNGEQASESEQGGYQIISLSAQTHDGVKLLRDHLKQAMGFQTGIEGGFLARRRHLDALEKAAEHLQIGLVQLTEFHAGELLAEELRLVQSYLSEITGQFTSDDLLGNIFSSFCIGK

SEQ ID NO: 3631 - protein, 622 aa, H. influenzae strain 86-028NP
MLIEKMHNLTNSKVSKFILGLITVSFLVGGMSGYLFSSNDTYAAKVNGEVISQQDFLNRYNQEFEIRAQREGEAFVAQSDSPEFVTALRQNIVNLMIDQELLRQYVKELKLGVSDEMIKRAIVTDPNFQVKGKFDNAVYQRILQQNHLTSDGYASILRASLPLEQIQNGVANSEFIVPAQVKNSAEVFFQKRLARLATLSLEDEMAKQSVSDDEIKTYYEANQKSFVQPEQVKVQYIDLSADNISRNLQVTDVEIAQYYQDNKAQFMTQHLAHIQFANEQDAKVAYEELQKGANFADVAKAKSLDKISGENGGDLGWVNENELPKAFEDAAAALQVGQYSQPINVDGNYHIVLVQERKAQSLENVKAQIADLVRKSLMESRYFSLEKQASDKAFEDSKSLNTAAQAAGVKVQESDYFSRQNVPAGLNFPNVIYTIFESDTTNVGMNSEPINVGDYHTIIVRVLDRKAEGVKSLEEAKIDIETFLKRQKAENALNEKAQQAVKKLSENPESKVDGINFSSEQTFTLSENKDPILTNGIFSIAKPKSNEALYQVVHNSNGDVVVVALNKVEQGSLSEKELSQFGMQLLRSHQSELQFQLIQGLRERAKIEVNDSFINQDDEVQQ

SEQ ID NO: 3632 - protein, 519 aa, H. influenzae strain 86-028NP
MMFGKEIIHSKTIWFYFLLFLFSIFTNMGLGNVLSENIPVSDYAILFVITAISFYFTPWLGRILITVLFLSALFYCSAGFFYGIPSLGIIASVYETNINETLEYYTTIPFWIFLFQVSYIILFVALMKLSFYVKQQAFKWLNMVVISLLLVFSYNQFSNWNYAYKFRFYPVLFYSEFDRMNDLYLEQRDFLNQSVNAPSQWDIQSFTPKYKNYILIIGESMRKDYMSLYGFPLKTTPFLERVKSTVFENYYSAAPNTQPSLQHTLYRADKGETVYTDNIISLAKKAGVKTYWISNQGKIGEFDTMASRIGQSADETIFMKPLGYNSKKVYDDEMLPVLDKALKENITNPKLIVIHLMGSHPAFCERLPYEVKNYFINQSMSCYLESIKYTDQFLEKLNSQLVSQNEPYSVIYFSDHGLAHYEDSEGLSLHPNNLYKQNYEIPFVMFSSDSKKLEKIKTPQSAFNFVYGFADWMGIKEKHLQGVDFFHPEKQEIKVFDWNNVVNVKELADDPAKLPEAVQ

SEQ ID NO: 3633 - protein, 171 aa, H. influenzae strain 86-028NP
MSKKSGLSFLWLSAVAFVVDLLTKYIVVQKFDLYESVNVLPVFNLTYVRNYGAAFSFLADHSGWQQYFFILLALAISGMLVYFLAKNNAEQKIQNSAYALIIGGALANMVDRTYNGFVVDFFDFYWDIYHYPVFNIADIAICIGAGLLALDAFKSEKKKVQDKQVEKCGQK

SEQ ID NO: 3634 - protein, 314 aa, H. influenzae strain 86-028NP
MKIILANPRGFCAGVDRAISIVELALEIHGAPIYVRHEVVHNRFVVNGLRDRGAIFVEELSEVPDGAIVIFSAHGVSQAVRQEAKDRNLKVFDATCPLVTKVHMQVARASRKGTKAILIGHKGHPEVEGTMGQYSNEDGGIFLIEKVEDIARLPMQDNDDLTFMTQTTLSLDDTAETIAALKEKYPAIQGPHKNDICYATTNRQEAVRELAKLSDLVLVVGSKNSSNSNRLAELASRMGIKSQLLDDPSDIQDDWFNDVKTIGITAGASAPEELVQSIISRLKEFGADTIEELQGLEENMFFEVPKELRIKEVN

SEQ ID NO: 3635 - protein, 115 aa, H. influenzae strain 86-028NP
MKLMKTLFTSFVLCGSLAAGSTFAEDKVVEQTTQAVVTTQTDSQVAPAMMGDKLNINIATASEIQKSLTGIGAKKAEAIVQYREKHGNFTNVEQLLEVQGIGKATLEKNRDRIIF

SEQ ID NO: 3636 - protein, 332 aa, H. influenzae strain 86-028NP
MKLLKLTLISTALFSTAALAQSQQSVNVYSYDSFTSEWGAGPKVKQDFEKAHPQCTINFTPFESVGVLLNRVRLEGKKTKADIVLGLDNFFLEQAEKTGIFAPNNVDLTQLDLPTKWTNKTFLPFDFGNYAFVYDKTKLQNPPKSLKELVERQDLRVIYQDPRTSSVGRGLLVWMNVIYPEDKIQSAWKNLDKHTVTVGKGWSDTYGAFLKGEADLVLSYSTSPLYHQLFEKKDNYAATDFAEGHITQVELAARVANHPNQCADDFMAFLISPTAQKHIVTANIMLPVIQGEIEPHFDALKVQQKTQTPINPTVNAEQLKNWISTWQTTLTK

SEQ ID NO: 3637 - protein, 538 aa, H. influenzae strain 86-028NP
MLSLFHHPQLRPRHYAGGVVVISFIILFYGSALSSIFTLGDELQWRAWFTDDYLQHLILFSFGQALLSTVLSIFFGLLLARALFYKPFFGKKWLLKLMSLTFVLPALVAIFGLIGIYGSSGWLAWFANLFGMSWQGHIYGLSGILIAHLFFNIPLAAQLFLQSLQSIPYQQRQLAAQLNLQGWQFVKLVEWPVFRQQCLPTFSLIFMLCFTSFTVVLTLGGGPQYTTLETAIYQAILFEFDLPKAALFAMLQFVFCLLLFSLTSRFSPSNQNGLSNSNIWFVKPKSAVKIFYVFVLIVFVFFLFSPVLNILISALSSSSLLKVWHNSQLWRALGYSLSIAPLSALLALTMAIALLLLSRRLEWLHYQKIAQFIINAGMVILAIPILVLAMGLFLLLQERDFSNIDLFIIVVFCNALSAMPFVLRILSAPFHNNMRYYENLCNSLGIVGWQRFYLIEWKTLRAPLRYAFALGLALSLGDFTAIALFGNQEFTSLPHLLYQQLGNYRNQDAAVTAGILLLLCGILFAFIHTYRDADDLSK

SEQ ID NO: 3638 - protein, 217 aa, H. influenzae strain 86-028NP
MLMIYLNNVILNDKTLPMCFNLNVKAGERVAIIGESGAGKSTLLNLIAGFEFPAQGEIWLNDKNHTRSAPYERPVSMLFQENNLFPHLTVQQNLALGIKPSLKLTALEQEKIEQAACSVGLGDYLERLPNSLSGGQKQRVALARCLLRDKPILLLDEPFSALDQKLRVEMLALIAKLCDEKDLTLLLVTHQPSELIGSIDQVLVVENGQISQLQKGV

SEQ ID NO: 3639 - protein, 333 aa, H. influenzae strain 86-028NP
MLAEKLQINSITPHPSVEYWSVCKVEALFETPFLELVYRATQVHRKHFNPRAIQLSTLMSIKTGGCPEDCSYCPQSARYHTGVQNQQLLDVDEIVAKAKIAKARGAGRFCMGAAWRGPKPKDIEKVTEIIKAVKSLGLETCGTFGLLQDGMAEDLKEAGLDYYNHNLDTAPEHYAEVIGTRRFDDRLSTLGKVRKAGLKVCCGGIVGMNETRKERAGLIASLANLDPQPESVPINQLVKVEGTPLADAEELDWTEFVRTIAVARITMPKSYVRLSAGRSGMTEEMQAMCFMAGANSIFYGDKLLVTDNPEEDGDQLLMAKLDLEPETAENKKL

SEQ ID NO: 3640 - protein, 665 aa, H. influenzae strain 86-028NP
MATRRQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAERFEAYGWQVIRNVNGHNAEQIRAAAVLAQAEKEKPTLIICKTIIGFGSPNKSGSHDCHGAPLGDEEIALTRKALGWEYAPFEIPAEYYAEWSAKEKGAAAEKSWEEKFAAYAKAYPELAAEFKRRVSGELPTNWAAESKAFIEKLQANPASIASRKASQNAIEAYAHLLPEFLGGSADLASSNLTLWSGSKPIRAHENVSGNYINYGVREFGMSAIMNGIALHGGFIPYGATFLMFYEYAHNAVRMAALMKQRTLFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVQAAEALSAEGKKVRVVSMPSTNRFDKQDEAYRESVLPAAVTKRVAIEAGIADFWYKYVGFNGRVVGMNSFGESAPADQLFKLFGFTVENVVAKAKEIL

SEQ ID NO: 3641 - protein, 314 aa, H. influenzae strain 86-028NP
MQIQCFESITQKYPQFPTALLANEEPIQNGEPFILYGTKLDITKLEKFQQKCGQNFQIFDVWMVAKNIIVLLKGQWFSDFIKFAHDVEVDIAKLDFSPKLSQAGLLVMDMDSTAIQIECIDEIAKLAGVGELVSAITESAMRGELDFEQSLRCRVGTLKGAPESILQQVRENLPLMSGLVETIQTLQKYGWKTAIASGGFTYFADYLKALLQLDFAASNQFDIEDGKLTGLVKGDVVDAQYKAKTLQHLLEEYGIYSQHSIAIGDGANDLAMMNVAGLGVAFHAKPKVQQQAQIVVNFADLTALLCLLSANDRI

SEQ ID NO: 3642 - protein, 163 aa, H. influenzae strain 86-028NP
MPSFDIVSEITLHEVRNAVENANRVLSTRYDFRGVEAVIELNEKNETIKITTESDFQLEQLIEILIGSCIKRGIEHSSLDIPAESEHHGKLYSKEIKLKQGIETEMAKKITKLVKDSKIKVQTQIQGEQVRVTGKSRDDLQAVIQLVKSAELGQPFQFNNFRD

SEQ ID NO: 3643 - protein, 315 aa, H. influenzae strain 86-028NP
MINAFAINDSRLVRIDEDQTDLNTAIWLDLLEPTGEEREILQEGLGQSLASFLELEDIEASARFFEDEDGLHLHSFFYCEDEDNYADLASVAFTIRDGRLFTLRDRELPAFRLYRMRSRSQRLLECNSYEVLLDLFETKIEQLADVIENIYADLEELSRVILNGKQDEAFDEALNTLTEQEDTSSKVRLCLMDTQRALGFLVRKTRLPTNQLEQAREILRDIESLQPHNESLFQKVNFLMQAAMGYINIEQNKIMKFFSVVSVMFLPATLVASTYGMNFDFMPELHFKYGYPMAIGLMIAAALTPYIYFRRKGWL

SEQ ID NO: 3644 - protein, 184 aa, H. influenzae strain 86-028NP
MVMMELSQTALFIGSIINLYALVVILRAWLQFARVDYYSPVSTFAVKMTDPILKPLRKIAPTVKNIDTSALLLVFIIGMLKGIIYFGLSVNVLLVLGVLTVLKSIGLAIFYVLFIGAVLSWFNRGNNSISYAFYQLSEPLLKPIRRFLPTLGMIDFSPMVVVFILLFLNNFMLDLLGGLWIIAG

SEQ ID NO: 3645 - protein, 294 aa, H. influenzae strain 86-028NP
MVLNHSHIVRLYLIKIMCQLLGMNCNTPTDIVFSFEGFRRRAGLTDCHSDGFGVAFFEGRGVRIFRDNQTASLSPIADCVKQYNIKSLNVIAHIRKATQGEVNIENTHPFIREIWGQNWVFAHNGNLKNLPDMTDHFLQPIGSTDSEAAFCYMAEYLKNTFRKKPSEMEIFEAIQKVTQELAQHGTFNFILSNGEWMIAHCSTNLHYVMRKAPFGKAHRIDDDGVIDFSNYAKAGDKVNIITTFPLTKDESWTKMENGGFVFFKNGEKIAEVIGTPKEAIDDGTLGNRTINSAI

SEQ ID NO: 3646 - protein, 175 aa, H. influenzae strain 86-028NP
LHSPQFPLSYAPLISPNFVFMNKLKMALFVGALVSLFACTTIHQPKKTVKSRFLKNNISQTELNNSVNYKPYHYRCNNKETGGISHLTTYFPLSRESRMKENFSFYFQLDNGKAIPFDHLYTLTLNTRGTKFEAIYRSYDPIQGSYVDLIVRSQSSIYYKNQQGKQVTWLNCKGG

SEQ ID NO: 3647 - protein, 400 aa, H. influenzae strain 86-028NP
MSKTMISRENYLQQLIQFKDTDFIKVISGVRRSGKSVLLMQYRDYLQQQGIASENILYLNFESFEYQWVKDAQDFQQLIQEKMPSSQKKIYFLIDEIQFVEGWQKIVNGLRVSFNADIVITGSNANLLSGELATLLSGRYVEIKIYPLSFKEFLHAKNVDSQSRLVDKLYSEYEKYGGFPSVVMADEPLKETILSGIFDSIVLNDIAHRAGVKDTHILKSVILFLADNVGQLVNPSKISNTLTSERVPTSNHTISKYLDLLENAFLFYKAKQYDIRGKGYLKTNAKYFIVDNGLRRHAIGKKGANYANRLENIVFIELLRRGYTVDVGKLDSKEIDFIARKADEILYVQVAFEIPENTHETDNLLHIKDNYKKILITGKYYEQTEIDGIEVIYVVDWLLQ

SEQ ID NO: 3648 - protein, 449 aa, H. influenzae strain 86-028NP
MGENFMSLNNSLTTFNSQLPDLSVNTIPAINQLVSALRIPRDVLASDEEIRYAWNDLPRELRNIPVQNVNPELIARMCIAISSGLFDGAINYIWNASILRLRDKVRTFGLPIVAQVLERDFEEGHLIALQDSQLLDLCLQLNILNEEGFLFLGQCRNIRNNFSAAHPSLGNLNDREFITFLNRCIKYALGDSSSPKGVNISDFIQSIKGGRFNQEQREYWIDRLSKTHEAQKQLLIIMAHGIYCDPNSQETTRLNALDICAFFQNSFSASLKSSLIDKHSEYIAKGDEQRLRASSQFFEKLSLLGLLSAPQQHAIFSAAINRLQIAHDGLNNFYNEPPYAERLAELSQNTAVPETAQSDFVDTIVSCYLGNKYGVSWGAIPFYEKIIRNFSPKEINLMITHAKINSSKIGRKTNDEYGRIRFIEALKLIDSGSIPSGVRPAYDQLLNNK

SEQ ID NO: 3649 - protein, 166 aa, H. influenzae strain 86-028NP
MKNEAYYQAYLSHHHISRRGLLRHIFPATKSTIEKTQSRPPFSAREDLFSAVCNGCGECASACPNGLIQLKQQQATLEIDYAPCDLCGKCAEVCPTNALHPNFPADTLLRPQFSSACLILQNQTCPDCQTACTQQAISSTLEIDNERCNGCGECKITCFVAAITLK

SEQ ID NO: 3650 - protein, 203 aa, H. influenzae strain 86-028NP
MQNTLQQISIYGRLLGAVFYYEPNDARLTDILTFFRQPNWMQEWEISFDVKTHKKITALIEKGLQQNINEQYQYLFIGPNELPTPPWGSVYLDPECVIFGNSLLALRDFLQQHQIAFQTQQDEPEDHIGLMLMLAAYLAENRPHLLIEFLREHFLTWAYHFLEQLSKIENSDFYQALALLTLKTLQQWQVDLHINIPTVRFYR

SEQ ID NO: 3651 - protein, 279 aa, H. influenzae strain 86-028NP
MNTGLYELPLVFFTVLAQSAVGAWLVFTFVLLNEKNTKSRTYIHKVMFVILALLGIGFIASIMHLGLPIRAFNSLNRVGSSMMSNEIATGAIFFALAGFYWLIAILGKMPASLGNVWRIVTALIGILFMYVMNQVYHITSIPTWNNALTSWSFYLTVVLGGLTLSYALLIPNKQREYQLQHLPSLFAIGVLLVAIVAIYQGFNLHNIHSAIQNAADLVPNYAIMTVTRLCLLSIVAFLLFRVKNIGLLGISVLLTLVAEGIGRVLFYGLHMTYGMAIGG

SEQ ID NO: 3652 - protein, 205 aa, H. influenzae strain 86-028NP
MEQYGFYFDSERCTGCKTCELACKDYKDLGTEVNFRRIYEYTGGQWNQQADGCWHQNIFAYYMSISCNHCADPACTKVCPTGAMHKNADGFVIVNEEICIGCRYCHMACPYDAPQYDAQKGHMTKCDGCYSRVKSGQKPICADACPLRALDFAPIDELRAKYGTQASIAPLPPADITQPNLVVKPNKHARLSGDTSGFLGNPREV

SEQ ID NO: 3653 - protein, 806 aa, H. influenzae strain 86-028NP
MSNFNQISRRDFVKASSAGAALAVSNLTLPFNVMAKETQHLNENSQERIVWSACTVNCGSRCPLRMHVKDNRITYVETDNTGTETYNLDHQVRACLRGRSMRRRVYNPDRLKYPMKRIGKRGEGKFKRISWDEALTEIADALKRNIKKYGNESIYLNYGTGTLGGTMAKSWPPASTMIARFMNCIGGYLNHYGDYSTAQIAVGLDYTYGGGWALGNGMADIENTKLIVLFGNNPAETRMSGGGLTYCIEQAKARSNAKMIIIDPRYNDTGAGREDEWIPIRPGTDAALVSALAYVMIQENLVDQPFLDKYCVGYDEKTLPADAPKNGHYKAYILGYGNDGIAKTPEWAAKITGIPAERIIKLAREIGSTKPAFISQGWGPQRRSNGELISRAIAMLPILTGNVGIHGGNTGARESAYSIPFVRMPTLKNPVKASIPMFLWTDAIIRGTEMTALTDGIRGVDKLSSPIKVIWNYASNCLINQHAQINRTHDILQDDTQCEMIITIDNHMTSTAKYSDILLPDCTTSEQMDFALDAFVSNMAYVIFADQVIKPSFECRPIYDMLSDLAEKMGVKEKFTEGRTQEEWLRHIYEQSREKLPELPTFEEFRQQGIFKKVDPNGFKVAYKDFRDNPEAHPLKTPSGKIEIYSSRLAEIANTWKLAEDEIIHPLPIHAQSFEHYGDPLMEKYPLQLSGFHYKARTHSTYGNVDVLKAANPQEVWMNPIDAEPRNIKNGDMIRIFNDRGEVRINVKITPRIIPGVVALSEGAWYAPDKDRIDHSGCINVLTTQRPSPLAKGNPQHSNLVQVERL

SEQ ID NO: 3654 - protein, 369 aa, H. influenzae strain 86-028NP
MKKLIAVAVFSACGSLAHANTIIPNYNTDAHLYEFTQTYDLVVPKGSQGQTNLWVPLPFNGEYQQVKSIHFEGNYMNAYVTENNKYGAKTLFATWDKDAQKRDLKVTMVIETKDREPMVKGALENYTPPKDIQYSVDVQEYLKATPHIKTDGIVKEFADKILGKETNPLKKAELIHHWIVKNMERDNSVLGCGDGDVEKILTTGVLKGKCTDINSVFVALARAAGIPAREIFGIRLGTAEKMGKYSKGAFGSANEQGIVNVSGGQHCRAEFYLAGFGWVPVDSADVAKMRLAEKKSVEDKDTQAVAKYLFGNWEANWVGFNHARDFDLYPQPELAPINNFGYPYAEVGGDPLNSFDPKEFKYDYVSKKL

SEQ ID NO: 3655 - protein, 97 aa, H. influenzae strain 86-028NP
VASTLCCIAPLIYLVFGVSSTWLIGLGEYDYLRIPMLIISLCAFAYGFWLLMFSKKIICSKYISRKKLIVLYWIVFIVMIFFLTYPTILPWILELAN

SEQ ID NO: 3656 - protein, 92 aa, H. influenzae strain 86-028NP
MKKLCTALLLSLFAISFAHANETKQIVLKVKEMNCQLCAYLVNKELRNIDGVISTKASIKDGLVTVVEDPKVTNQQLFDAIHKLKYTAEVVN

SEQ ID NO: 3657 - protein, 614 aa, H. influenzae strain 86-028NP
MFNKIFSWFENRLNPYPESNPTTPKKGLFRFIWSSITGMKGWIFLLAILTVGTGVMEAVLFQFMGTLVDWLGTFTPERLWQEKSHLLIGMAALLLISIVWGFLASAVHLQTLQGVFPMRLRWNFHRLMLGQSLSFYQDEFAGRVSAKVMQTALAVRDTVLTLADMFVYVLVYFITSGVVLVALDSWFLLPFITWIILFGLILRTLIPKLSKTAQRQADARSLMTGRITDAYSNIATVKLFSHGSREATYAKRSMQDFMVTVHAQMRLATSLDTLTYATNILLTLSTAILGIILWKNGQVGVGAIATATAMALRVNGLSRWIMWESARLFENIGTVNDGMNTLTKPHTIVDKPQASPLQVKQGEIKFNDITFAYDPTKPLLNHFNLTIKPGEKVGLIGRSGAGKSTIVNLLLRFYEAQQGEITIDGQNVLNVQQESLRRQIGLVTQDTSLLHRSVRDNIIYGRPNATDEEMVLAAERAEAADFIPFLSDSQGRKGYDAHVGERGVKLSGGQRQRIAIARVMLKDAPILLLDEATSALDSEVEVAIQESLDKMMENKTVIAIAHRLSTIAAMDRLIVLDKGQIVEQGTHAELLELNGLYAKLWNHQSGGFLSGSAE

SEQ ID NO: 3658 - protein, 298 aa, H. influenzae strain 86-028NP
MDYLDKLTHLAQVRGEINIRCEFQGEWQISHQEKDAGKGIFHLIEQGECQLTLNEKQFHLKEGDIFFLPQNQPHFMHYSVNKRADIPTKKSHQGLFELHQIGRGTPDLKMFCGNFYYQQDALLTASMPEYLHINLCDTPIHPLVQLFLQEAQKNDAGTKSVVDALSNVLLIYILRHAIQQNLIEQGILFALQDKRLNTALIAILQQPQNDWHIEQLAELATMSRANFIRVFQQQLGMSPGRFLTKVRLQSAAFLLKQSQQSVLAIALEVGYQSEAHFCKVFKNYYQLSPSQYRKSVSL

SEQ ID NO: 3659 - protein, 113 aa, H. influenzae strain 86-028NP
MFADWKEHTSHVKKSFGALGKQHPKMLQAYQALGSAAEEGNVLDAKTRELIALAVAVTTRCESCISVHAEEAVKAGASEAEVAAALATAIALNAGAAYTYSLRALEAYSVQKG

SEQ ID NO: 3660 - protein, 198 aa, H. influenzae strain 86-028NP
LEMVEKRLNESDMPFIGTKEFTPKKLWEIFGTPKQKWVKKDDVKTAIAMQNDWYVMDNFAGTSLEEALIQFISERLGDLKSKYDVHLIRNEEVFKLNNFADGEGFMPDFVLLLKDKQKSSSNGVNDFLHYQIFIEPKGEHLVETDRWKEAFLKSITVEYGKDKILQKDTPHYRLIGLPFFTDHQKNGQFTELFPLGET

SEQ ID NO: 3661 - protein, 721 aa, H. influenzae strain 86-028NP
MANNKTLFDWVEDRKSMLEEMEQTDFFALPEFVSNNLKYPFFEWQKSALENFVIFDRTPKLKDFPDIKNRPTHLLFNMATGAGKTMMMAALILYYFEKGYRHFLFFVNQNNIVDKTENNFTDPTHAKFLFTEKILQGDTVIPIRKVETFSPHSDGIEIKFTSIQKLYNDIRTRRENQTTLADLHKLNLVMLGDEAHHLNAQTKGKKQGELDLEKEMNDRTSNAEIERKGWEHMVLELLLNKNGNHSQNVLLEFTATLPENADVQQKYADKIITKFGLKEFLQKGYTKEINLVSSTLGKKERVLHALLFAWYRHRIALKYGIANFKPVMLFRSKTIDESKADYLAFLNWAENVQAVDFSFLTTFSTSLNDSDSDNANEQGKTRTEQALKFMQEKGVEFAHLADWVKQNYQKHNVIITNSESNKTKTEKTDSETEKLLNNLEAADNPIRAIFTVDRLTEGWDVLNLFDIVRLYEGQNGGGSNKKSGKTAAATVSEKQLIGRGVRYFPFAFEDKQPNKRKFDNDMQHELRILEELFYYTHDEQSRYISELKAELRKDGFIPENDKDKVLTTFKLKSEFADDETFKNLLIWANQKVKNPNAKANNADSLKANPQTLSFQIHGNQLLQETQFTADENDETARQIGTQNNFTQTIKMSEMERHIFNKALHIKGKNSQSLFHFDRLQSKLNIQNRNELQNNLLKDWQIEFLGLGQDKQISPDDNLQAA

SEQ ID NO: 3662 - protein, 197 aa, H. influenzae strain 86-028NP
MFEYPQGYELIAGVDEVGRGPLVGAVVTAAVILDPNNPIEGLADSKKLSEKKRLALAEEIKEKALAWALGRAEANEIDEINILQASLLAMTRAVKSLKIQPHFVLVDGNKIPKDLAIPAQAVVKGDNLVAEISAASILAKVARDQEMEELDKQYPEYAFAQHKGYPTKLHLEKLAELGALPQHRRSFAPVKKALEQF

SEQ ID NO: 3663 - protein, 390 aa, H. influenzae strain 86-028NP
MNKTNPTIALVAGEVSGDILGAGLIRQLKAHYPNARFIGIAGTRMLAEGCKTLVDMEELSVMGLAEILKHLPRLLKIRKNVIQTMLQEKPDVYIGIDAPDFNLDVELKLKANGIKTIHYVSPSVWAWRQNRIHKIAKATHQVLAFLPFEKAFYDKFNVPCRFIGHTMADAIPLKPNRAEACQMLQIDPAQRYLAILVGSRGSEVEFLAEPFLKTALLLKEQFPDLQFLVPLVNEKRRIQFEAIKAKIAPNLDLHLIDGNARQAMIAADATLLASGTAALEAMLCKSPMVVGYRMKPLTYFLAKRLVKTDYISLPNLLANEMLVPEMIQEECTPELLAEKLSAYLSDDESAVKNRHILIQHFTDLHQKIQCNADKQAAQAVIDLLEGTENV

SEQ ID NO: 3664 - protein, 262 aa, H. influenzae strain 86-028NP
MIHPSAKIHPTALVEEGAVIGEDVFIGPFCIIEGSVEIKARTVLKSHVVVRGDTVIGEDNEIYQFASIGEVNQDLKYKGEATKTIIGNSNRIREHVTIHRGTIQGCGVTSIGNNNLLMVNVHVAHDCQIKNNCILANNATLAGHVELDDFVIVGGMSAIHQFVIVGAHVMLGGGSMVSQDVPPYVMAQGNHARPFGVNLEGLKRRGFDKPTMHTIRNIYKMLYRGGKTLEEVLPEIEQIAETDSAISFFVEFFKRSTRGIIR

SEQ ID NO: 3665 - protein, 148 aa, H. influenzae strain 86-028NP
VSEQQPRVIESKEIMTLLPHRYPFLLVDRVLDFKEGEWLKAIKNISVNEPCFTGHFPGEPILPGVLILEALAQAMGILAFKTLELKGGELFYFAGIDEARFKRPVLPGDQMELNVQVIKERRGITSFTGVATVNGEIACEAKLMCARR

SEQ ID NO: 3666 - protein, 535 aa, H. influenzae strain 86-028NP
VDNSDIFFSGKTMMNTKKTSQILPALFAVICAAFAGYFILIGSGMFTEPTVDLILLATITILLLSSSKKSFYFILLPLTLLHAFYTPTGLNFGPPSYQYIASLFATDILETKEFLLQIPVSSYLIAFAIPILIFLQYKSAVKFGIKFYRNKTFIALATLLFAYNMPLAEPIKETISSTLKIVDEVQKLKQISQSDNWGKSTLENSRYDDYVIVLGESARKDYHHAYGYPIENTPFMSNAKGTLIDGFRSAGTNTVASLRLMLTLPNKEKWEPNYSLSLVDLIKSAGVKTYWLSNQGMLGKFDTPVSSLASKSDETFFLKKGGSFNSTNFSDFDLLPKFAQVLENSVQGKRFIVLHIYGSHPMACDRIEDYPKIFDDKDLNPKYGYLNCYVSSIKKTDEFLKRVYDQLEENAKKNHRTFSMIYFSDHGLCHQQDEKNNILLFNQNCFSREHHNIPLFKISSDDMERKEYKVFKSGLNFLEGIANWIGIQNPQLTQTEDLFSNESDKNDFGLQKRIDEKYRKDDDPAIDIRPKHGAY

SEQ ID NO: 3667 - protein, 237 aa, H. influenzae strain 86-028NP
MSQPIYKRILLKLSGEALQGEDGLGIDPAILDRMAVEIKELVEMGVEVGVVLGGGNLFRGAKLAKAGMNRVVGDHMGMLATVMNGLAMRDSLFRADVNAKLMSAFQLNGICDTYNWSEAIKMLREKRVVIFSAGTGNPFFTTDSTACLRGIEIEADVVLKATKVDGVYDCDPAKNPDAKLYKNLTYAEVIDKELKVMDLSAFTLARDHGMPIRVFNMGKPGALRQVVTGTEEGTTIC

SEQ ID NO: 3668 - protein, 321 aa, H. influenzae strain 86-028NP
MTLDYPVPFHTPNLVWDYTIAIYLFLLGISSGAVQLAIAYKRSNKLENLSQNWIIRSGVILGSVPTLIGLTLLIFHLTRPWTFWKLMFNYQFNSVMSMGVMLFQIYMLFLVIWGVVIFKKEIEALINRFIPKLQFVMKLIGIAERIASPVEVILFILAAVLGAYTGFLLSALISYPMLNNPVLPALFLASGTSSGIAATFLIILIAGKLKGDSHESHFIHKFEVPIMVTELGLIVCFFVGLHFGGGQKTVALHNALSGFWGAIFWVGVLIIGILIPLIANMFVNDRLKYNRNFIILVSIFDLIGVFCLRFFVLYAGQLTVA

SEQ ID NO: 3669 - protein, 225 aa, H. influenzae strain 86-028NP
MTVCSRRNFVSGMGAVILMTGTSLPSFAKEDKADKPKRYAMIHDENACIGCTACMDSCRDVNQVPEGVSRLEILRSEPYGEFPNQEYEFFRQSCQHCTNAPCVAVCPTGASFIDKETGIVDVHKDLCVGCQYCIAVCPYRVRFIHPVHRTADKCNFCRDTNLANGKQPACVEACPTKALTFGDMNDPTSAVSRKVKEKPVYRTKVELGTQPNLYHIPFQHGEPRR

SEQ ID NO: 3670 - protein, 227 aa, H. influenzae strain 86-028NP
VIFKVKFEVTQMNLTSLINKSAKALALSAAFVALPFLAYADDAQKPADHVTYEPQLDNQRDPNQYCAKCHKFDKIDKNQTLDRSGGELHFGKFHGAHLDKKNPNNGKAITCVSCHGNVSENHRRGAKDVMRFEGDIFGNKKPMYSVQEQNQVCFACHQPDKLREKLWAHDVHAMKLPCASCHTLHPKEDAMKGIQPKQRVKLCVDCHGKQQKRKAEQDKLTKQKDKQ

SEQ ID NO: 3671 - protein, 538 aa, H. influenzae strain 86-028NP
MKIYLRFVWILIIILNFLLNLFITTNGVIIVNAFKKSLIVAASFASLSLFNSATAELVYKPLEQPVEPAKPDLKIESVNEKFAEKYPNQYNSWRSTANGDGENIIYADEENPRLIVLWGGYAFAKEYNAPRGHFYAVTDVRNILRTGAPKTANDGPQAMACWTCKGPDVPRLIAEWGEKDYFNAKWAKGGPEIVNSIGCADCHDTTSKDFAEGKPALRIARPHVLRALDALEKATAEKDKAEGRPHNNLSFNTAARTEKRAEICANCHVEYYFAGDIKQVTFPWDNGQTADDIEKYYDDIGFTDWTHSLSKAPMLKAQHPDFEIWSLGMHGKNGVTCVDCHMPKVQGADGKVYTDHQIQNPFDAFDHTCANCHDQSKEKLRDIVTSRKKEVKDVMGRLEDQVVKSHFEAKAAWDAGATKEEMEAALMDIRHAQWRWDYTAASHGGHMHAPEVVLRVLASGLDKVADARTKLAVILTKHGVKTPVQIPDISTADKAWKVMGIDIEKERKAKEEFLKTVVPQWEQQAREKGLLVDPPAQK

SEQ ID NO: 3672 - protein, 1302 aa, H. influenzae strain 86-028NP
MKNSSVKHTLTPLQQSLFSQLNDIMRVDQRRLSARIHGIGKIKSQEAQQAVAAEIQQQIEQARLRVEQRKSAVQNPIIFPESLPVSQRKVEIQKLLSEHQVIVVAGETGSGKTTQLPKMCLELGFGNLGMIGHTQPRRIAARSVAARIAEELETELGDLVGYKVRFNDQISDNTQIKLMTDGILLAEIQNDRFLNQYSCLIIDEAHERSLNNDFILGYLKQLLPRRRDLKLIITSATIDVERFSKHFNNAPIIEVSGRTYPVEVRYRPVVEDDQDQLQGILNAVDELQAEGRGDILIFMNGEREIRDTAEALQKQNLKYTEILPLFARLSAQEQNKIFHPSGLNRIVLATNVAETSLTVPGIKYVIDPGTARISRYSYRTKVQRLPIEPISQASANQRKGRCGRVSEGICIRLYSEEDFNSRPEFTDPEILRTNLASVILQMTALGLDDIEAFPFVDAPDKRHIQDGIKLLEELGAFETVQTKSGEKRLLTRVGRQLAQLPVDPRLAKMILSAVNFGCVYEMMIIVSALSIQDPRERPQEKQQASDEKHRRFADKKSDFLAFLNLWYYLQEQQKELSKNQFRRQCQKDFLNYLRIREWQDIYHQIRLTVREMGLPINSEKAEYQQIHTALLSGLLSHIGLKEAEKQQYLGARNAHFAIFPNSVLFKKQPKWVMAAELVETSKLWGRMVAEIEPEWIEPLAEHLIKKSYSEPRWSKSRGAVIADEKVTLYGVPIVAARPVNYGAIDPTVSREIFIQSALVEGGWNTKHKFFKENQRLVQEVEELEHKSRRRDILVDDRTLFEFYDQRIGTEVVSQKHFDTWWKKVQQKDPELLNFERSFLINDDAEQVSKLDFPNFWYQGNLKLKLTYQFEPGTDADGVTVHIPLPLLNQVEMTGFDWQIPGLREELVIALIKSLPKSYRRNFVPAPNYTQAFLSRAVPLEKPLLDTLIYELRRMTGVTVEAEHWNWEQIPSHLKMTFRVVDENGKKIAESMNLDELKFNLKDRVQESISAVADDGIEQSRLHIWSFADLPQCYEQKQRGFSVKAFPAIVDEKDAVGIKLFETEFEQSVAMQQGLRRLLLLNVPSPIKYLHEKLPNKAKLGLYFTPFGRVLDLIDDCIACAVDKLIANFGGFVWDEAGFEKLRDFVRENLNEVTVDIAQKVEQILTLTYQLNQRLKGKMDFTMAFALSDIKSQLAGLVYQGFVQKSGYDRLPDLQRYLQAIDKRIDKLAQDVNRDRAAMLRVEQVQQAYQQLLAKLPKSKPISDEIAEIRYMIEELRVSLFAQQLGTKYQISDKRIANIISQY

SEQ ID NO: 3673 - protein, 124 aa, H. influenzae strain 86-028NP
MKNKYLTIATLSGFFCVALGAFAAHGLSHILEAKALSWIDTGLEYQMFHTIAVLAVALSALRDNKFARLSMSSWLIGILLFSGSLYALAFEASNVIVWITPIGGTLFLIGWISLAYGSFKSKSL

SEQ ID NO: 3674 - protein, 150 aa, H. influenzae strain 86-028NP
MTLQLNTIALLLVILLILGVLSNNSAITISAAVLLIMQQTFLSSHIPLLEKYGVKIGIIILTIGVLSPLVSGKIQLPDLSGFLSWKMALSIAVGVLVAWLAGKGVPLMGEQPILVTGLLIGTIIGVAFLGGIPVGPLIAAGILALLLGKI

SEQ ID NO: 3675 - protein, 378 aa, H. influenzae strain 86-028NP
MIDYEFLRFIWWVLVIVLLIGFSVTDGFDMGVTALLPVIGKKEVERRIMINTIAPHWDGNQVWLLTAGGAIFAAWPIVYAVSFSGFYIALVLVLAALFLRPLGFEYRAKIDNPTWRSVWDWGLFAGGFVPALVFGVAFGNLLQGVPFHFNELTQVTYTGSFFELLNPFALLCGVISLSMLVTHGANWLQMKTTEVLRDRARSVSQIGSIVTLITFVLAGVWLYSKDGYVVTSTIDHFAPSSPMNKEVAVETGAWFRNFNEMPILWIFPALAVVAALLNAAFSKANRCGFAFFFSALTMAGVIITAAVSMFPFVMPSSSHPEQSLLMWDSTSSELTLTLMLIFAVVFVVIALAYTIWSYSKMFGRLDANFIDKNKHSLY

SEQ ID NO: 3676 - protein, 521 aa, H. influenzae strain 86-028NP
MLDVVDLSRLQFALTALYHFIFVPLTLGLSFILVIMETIYVATGKEVYKDMTKFWGKLFGINFALGVTTGIIMEFQFGTNWSYYSHYVGDIFGAPLAIEALLAFFLESTFVGLFFFGWDRLSKGKHLLATYCVAFGSNLSAMWILVANGWMQAPTGSKFNFETVRMEMTNFLDLWLNPVAQSKFLHTLSAGYVTGAFFVLAISSYFLLKGRDFEFAKRSFSVAATFGFIASISVLILGDESGYDIGKAQPVKLAAMEAEFETHPAPAPFLPVAIPNTAEMKNDFAIEIPYLGGVIATRSIDKEIIGLKDLQALNETRVRSGIRAYELFTQLRAEKKANGQVNEETKAQFNEVKKDLGFGLLLKRYTNNVVDATEEQIKQAARDTIPNVGPNFWAFRAMIAAGGLIALLTFGAFVQNLRNKVTQIPLLLKVLLWGLPLPWIAIECGWFLAEYGRQPWAIYEILPVGVSASNLSTGDLWFSIGLICALYLAFIIVEMYLMFKYARLGPSALKTGKYYFEQSAK

SEQ ID NO: 3677 - protein, 545 aa, H. influenzae strain 86-028NP
MATNYIFVTGGVVSSLGKGIAAASLAAILEARGLNVTIMKLDPYINVDPGTMSPTQHGEVFVTQDGAETDLDLGHYERFIRTKMTKRNNFTTGKIYSEVLRKERRGDYLGATIQVIPHITNEIKDRVIAGAQGHDVVIVEVGGTVGDIESLPFLEALRQLAVQVGREHTLFMHLTLVPYIPTAGEVKTKPTQHSVKELLSIGIQPDVLICRSDRMIPPNERAKIALFCNVAERAVISLKDVNSIYQIPALLKSQGLDDFVCERFRLTCPEADLTEWEQVLYKQANPVGEVTIGMVGKYTELPDAYKSVNEALKHAGLTNRLSVSIKYIDSQDVETKGVEVLKGVDGILVPGGFGYRGVEGKIRTAQYARENKIPYLGICLGMQIALIEYARNVAGLTKANSSEFDKDCEQPVVALITEWQDAEGNTEVRTDESDLGGTMRLGAQQCHLVSGSHARELYGKETIEERHRHRYEVNNTLLPQIEKAGLKVTGLSADKKLVEIIEVPNHPWFVACQFHPEFTSTPRDGHPLFAGFVKAAYENHKKSVK

SEQ ID NO: 3678 - protein, 226 aa, H. influenzae strain 86-028NP
MTLAARLKREFVSGWKPFEVVWLALFIIAQIWAYVQTPDSWLAMISGISGILCVVLVSKGKISNYFFGLIFAYTYFYVAWGSNFLGEMNTVLYVYLPSQFIGYFMWKANMQNSDGGESVIAKALTVKGWMTLIVMTTVGTLLFVQALQAAGGSSTGLDGLTTIITVAAQILMILRYREQWLLWIGLNILSIFLWAETPAIYLMYSAYLLNSLYGYYNWTKLVKRTN

SEQ ID NO: 3679 - protein, 257 aa, H. influenzae strain 86-028NP
MSMLKVSNIQKNFNGNHVLKGIDFEINKGEVVAILGPSGSGKTTFLRCLNLLERPEQGILEFTDGSLKIDFSQKISKADELKLRRRSSMVFQQYNLFPHRSALENVMEGMVVVQKQDKAQAREKALSLLEKVGLKNKADLFPSQLSGGQQQRVGIARALAVKPDIILLDEPTSALDPELVGEVLQTLKMLAQEGWTMIIVTHEMQFAKDVADRVILMADGYIVEQNTADKFFTCPQHERTKQFLLQAKIPLELDYYI

SEQ ID NO: 3680 - protein, 225 aa, H. influenzae strain 86-028NP
MSAERADYVISSFWPMLEAAILYTLPLAVISFFCGLLIAVIVAVIRTLPSPNLPLKLLQALCRVYISIIRGTPMLVQIFIIFYGLPEVGITLEPFPTAIIAFSINIGAYAAETVRASIIAIPKGQWEASYAIGMNYRQAFIRTIMPQALRISVPSLSNTFISTVKDTSLASLVLVTELFRVAQNITAANYEFILIYSEAALIYWIFCFVLSFLQDRLEIRLSRHL

SEQ ID NO: 3681 - protein, 257 aa, H. influenzae strain 86-028NP
MKKLLFTTALLTGAIAFSTFSHAGEIADRVEKTKTLLVGTEGTYAPFTFHDKSGKLTGFDVEVIRKVAEKLGLKVEFKETQWDAMYAGLNAKRFDVIANQTNPSPERLKKYSFTTPYNYSGGVIVTKSSDNSIKSFEDLKGRKSAQSATSNWGKDAKAAGAQILVVDGLAQSLELIKQGRAEATINDKLAVLDYFKKHPNSGLKIAYDRGDKTPTAFAFLQGEDALITKFNQVLEALRQDGTLKQISIEWFGYDITQ

SEQ ID NO: 3682 - protein, 424 aa, H. influenzae strain 86-028NP
MDKFRVYGQSRLSGSVNISGAKNAALPILFAAILATEPVKLTNVPELKDIETTLNILRQLGVIANRDETGAVLLDASNINHFTAPYELVKTMRASIWALAPLVARFHQAQVSLPGGCSIGARPVDLHISGLEKLGADIVLEEGYVKAQVSDRLVGTRIVIEKVSVGATLSIMMAATLAKGTTVIENAAREPEIVDTADFLNKMGAKITGAGSDHITTEGVERLTGCEHSIVPDRIETGTFLIAAAISGGRVVCQNTKADTLDAVIDKLREAGAQVDVTENSITLDMLGNRPKAVNIRTAPHPGFPTDMQAQFTLLNMVAEGTSIITETIFENRFMHIPELIRMGGKAEIEGNTAVCHGVEQLSGTEVIATDLRASISLVLAGCIATGETIVDRIYHIDRGYEHIEDKLRALGAKIERFSRSDEA

SEQ ID NO: 3683 - protein, 85 aa, H. influenzae strain 86-028NP
MELQKIEQILKDTLNIVEVYAQGENAHFGVIVVSDEIAALSRVKQQQTIYAPLMPYFSTGEIHALTIKTYTVEKWKRDRALNQFN

SEQ ID NO: 3684 - protein, 105 aa, H. influenzae strain 86-028NP
MLNWDLQKNNDKITLFLFGELSRSTLLPMWQQRGVFLSESTLDKTIVEWNLSGLQHIDSAGFTALCDFLRECQKINKTVRLVYPPKQLLTLADLVGLSDWIANFT

SEQ ID NO: 3685 - protein, 214 aa, H. influenzae strain 86-028NP
MYLTQLKKWFTILTFVLTALLVTRTAIAETSPYVLMQQASDKLFSDIQANQSKIKQDPNYLRTIVRNDLLPYVNLEYAGSKVLGSYYKSTSTEQREKFFKTFGELIEQKYAQTLTNYSNQKIQIESEKELGDNNFVNIRVSIIQTNGVAPILLDFKWRKGNKSGEWKAYDMAAAGVSMLEDTIKNWVGILNKQGIDTLITKMQQSASQPIIFNQ

SEQ ID NO: 3686 - protein, 166 aa, H. influenzae strain 86-028NP
MRQTIKYEFWVGLFLLLGIGALVFLGLRVANVQGFAETKSYTVTAIFNNIGGLKVRAPLKIGGVVIGRVSAITLDEKSYLPKVSIAINQEYNEIPENSSLSIKTSGLLGEQYIALTIGFDDGDTAMLKNGSQIQDTTSAIVLEDLIGQFLYGSKKSDGNEKSESAE

SEQ ID NO: 3687 - protein, 261 aa, H. influenzae strain 86-028NP; identical to SEQ ID NO: 697

SEQ ID NO: 3688 - protein, 264 aa, H. influenzae strain 86-028NP
MNQNLIEVKNLTFKRGDRVIYDNLNLQVKKGKITAIMGPSGIGKTTLLKLIGGQLMPEQGEILFDGQDICRLSNRELYEVRKRMGMLFQSGALFTDISTFDNVAFPIREHTHLPESLIRQIVLMKLEAVGLRGAAALMPSELSGGMARRAALARAIALDPDLIMFDEPFTGQDPISMGVILSLIKRLNEALNLTSIVVSHDVEEVLSIADYAYIIADQKVIAEGTSEQLLQSQDPRVVQFLKGESDGPVRFKYPAQDYMKELFE

SEQ ID NO: 3689 - protein, 215 aa, H. influenzae strain 86-028NP
MSYTLPELGYAYNALEPHFDAQTMEIHHSKHHQAYVNNANAALEGLPAELVEMYPGHLISNLDKIPAEKRGALRNNAGGHTNHSLFWKSLKKGTTLQGALKDAIERDFGSVDAFKAEFEKAAATRFGSGWAWLVLTAEGKLAVVSTANQDNPLMGKEVAGCEGFPLLGLDVWEHAYYLKFQNRRPDYIKEFWNVVNWDFVAERFEQKTAHCNCAK

SEQ ID NO: 3690 - protein, 212 aa, H. influenzae strain 86-028NP
MFEQHKLSLQNLSCQRGERVLFRALTCDFNSGDFVQIEGHNGIGKTSLLRILAGLAQPLEGEVRWDAEAISKQREQYHQNLLYLGHLLGVKPELTAWENLQFYQRISQAEQNTDMLWDLLEKVGLLGREDLPAAQLSAGQQKRIALGRLWLSQAPLWILDEPFTAIDKKGVEILTALFDEHAQRGGIVLLTSHQEVPSSHLQKLNLAAYKAE

SEQ ID NO: 3691 - protein, 221 aa, H. influenzae strain 86-028NP
MIFLEIIKRELQIAMRKNAEILNPLWFFLLVITLFPLVIGPEPKLLSRIAPGIAWVAALLSALLSFERLFRDDFIDGSLEQLMLTAQPLPMTALAKVVAHWLLTGLPLILLSPIAALLLSLEVNIWWALVLTLLLGTPVLSCIGAIGVALTVGLRKGGVLLSLLVVPLFIPVLIFASSILEAAGLNVPYGGQLAILGAMMVGAVTLSPFAIAAALRISLDN

SEQ ID NO: 3692 - protein, 246 aa, H. influenzae strain 86-028NP
MWKWLHPYAKPETQYRICGKLSPLFAFLTLILLGIGIVWGLAFAPADYQQGNSFRIMYVHVPTAIWSMGVYGSMAIAAVVALVWQIKQAHLAMIAMAPIGALFTFLSLVTGAIWGKPMWGTWWVWDARLTAELILFFLYLGILALYSAFSDRNIGAKAAGILCITTVVILPIIHFSVEWWNTLHQGASITKFEKPSIAIPMLVPLILCIFGFLTLYIWLTLVRYRVELLKEDAKRPWVKALAQTLK

SEQ ID NO: 3693 - protein, 67 aa, H. influenzae strain 86-028NP
MFFQTWSDFFNMGGYGFYVWLSYAVSLVAVIALIVQSVKQRKTVLQNVLREQQREERLQQANKGNTL

SEQ ID NO: 3694 - protein, 173 aa, H. influenzae strain 86-028NP
MNPRRKSRFKLVIFVVLGIAIASGLMLYALRQNIDLFYTPSEVIQGKDNNPNQKPEVGQRIRVGGMVVEGTVVRDPKSLKVRFDLNDIGPAITVEYEGILPDLFREGQGIVAQGVLTQSAVLSATEVLAKHDENYVPPELGEKMQKVHKPMGIKAADLKGESERDRQEKEGAK

SEQ ID NO: 3695 - protein, 648 aa, H. influenzae strain 86-028NP
MIAELGNYVLALSLAVSLMLAIFPLWGAEKGNVQLMALARPMTYGLFASLSIAFAALFYLFAVNDFSVQYIVNNSNTTLPIYYRLSAVWGSHEGSLLLWIWLLAVWSFAVALLSKHLPQEAVARVLGIMGIISVGFVLFVLFTSNPFTRTFPDFPVDGKELNPMLQDVGLIFHPPLLYMGYVGFSVAFAFAIASLMTGKLDSAWARWSRPWTLAAWVFLTLGIVLGSWWAYYELGWGGWWFWDPVENSSFMPWLAGTALIHSLSVTEKRGSFKAWTVLLAILAFSLCLLGTFLVRSGILVSVHAFASDPTRGLYILAYLVVVIGGSLALYAYKGSQIRSRDNAERYSRESMLLLNNILLMTALCVVFLGTLLPLVHKQLGLGSISIGAPFFDQMFLIIMTPFALLLGIGPLVKWRRDQFSAIRTPVVISVFVMLIAGFALPYFLQDKITVSSVLGSMMTVIIVLLVLYELQQRATHRESFFVGVRKLSRSHWGMMLAHLGVAMTVWGIAFSQNFSVERDVRMKVGENAQIGRYDFKFAGVTDENGPNYIGGKAQIDISKDGQPETSLFAEKRFYTVSRMSMTEAAIAGGLTRDLYVALGEKLEDNSWALRLYYKPFIRWIWIGGLFMALGGLLCMFDRRYRFNVLLKK

SEQ ID NO: 3696 - protein, 181 aa, H. influenzae strain 86-028NP
MKKKLLVPLILFLSITIAFLVQLKRNAQGEDIKALESALVGKPVPEKNLTELFENKAYTNELFQQGKPVLLNVWATWCPTCYAEHQYLNKLAKEGVRIIGLDYKDESPKAMKWLKDLGNPYQVVLKDEKGSFGLDLGVYGAPETFIVDGKGVIHYRYAGDVNEKVWTQTLKPIYDKLSEQQ

SEQ ID NO: 3697 - protein, 163 aa, H. influenzae strain 86-028NP
LFCVIIGSLFTSQFSIAENDSSAVDSEDKKAFNSDVSNNDAQKLAQSIEFKVYKIDETTSSESIYESPAGICQGFKITRGVDYTNSTYHYLYPDNRGEFYGSVVGATIYNQKDPQNLSYVPVYSITDKDLSKCIQAQENKKLKEKAANYVSEGRAVLTDVICK

SEQ ID NO: 3698 - protein, 102 aa, H. influenzae strain 86-028NP
MYLMRKIVFVSCVILGLAACSSQPEQIGGGVYDMKTVQEYNARVISGNTVTQTQKDKITQQIDTSLKLNQSDNKVKTRTRRVLPVLPVTPSVGYHYNYHYFR

SEQ ID NO: 3699 - protein, 679 aa, H. influenzae strain 86-028NP
VRSFFSENFMTNIQTQLDNLRKTLRQYEYEYHVLDNPSVPDSEYDRLFHQLKALELEHPEFLTSDSPTQRVGAKPLSGFSQIRHEIPMLSLDNAFSDAEFNAFVKRIEDRLILLPKPLTFCCEPKLDGLAVSILYVNGELTQAATRGDGTTGEDITANIRTIRNVPLQLLTDNPPARLEVRGEVFMPHAGFERLNKYALEHNEKTFANPRNAAAGSLRQLDPNITSKRPLVLNAYGIGIAEGIDLPTTHYDRLQWLKSIGIPVNPEIRLCNGADEVLGFYRDIQNKRSSLGYDIDGTVLKINDIALQNELGFISKAPRWAIAYKFPAQEELTLLNDVEFQVGRTGAITPVAKLEPVFVAGVTVSNATLHNGDEIERLNIAIGDTVVIRRAGDVIPQIIGVLHERRPDNAKPIIFPTNCPVCDSQIIRIEGEAVARCTGGLFCAAQRKEALKHFVSRKAMDIDGVGGKLIEQLVDRELIHTPADLFKLDLTTLTRLERMGAKSAENALNSLENAKSTTLDRFIFALGIREVGEATALNLANHFKTLDALKDANLEELQQVPDVGEVVANRIFIFWREAHNVAVVEDLIAQGVHWETVEVKEASENLFKDKTVVLTGTLTQMGRNEAKALLQQLGAKVSGSVSSKTDFVIAGDGAGSKLAKAQELNITVLTEEEFLAQITR

SEQ ID NO: 3700 - protein, 328 aa, H. influenzae strain 86-028NP
MDLNTILIIVGIVALVALIVHGLWSNRREKSKYFDKANKFDRTSPTSRSHTQEEMVQPNNISPNTYVENGHTPISQPTTEKLPSEAELIDYRQSDKSVDDIKISIPNTQPIYDMGNHRSEPIQPTQPQYDMPTANNVASMTLEQLEAQSQNVGFNGINSSSPELRVQLAELSHEEHQVDYNLSFNEPKAETTAQPKQTTGYIQLYLIPKSSEEFNGAKLVQALENLGFILGKDEMYHRHLDLSVASPVLFSVANLEQPGTFNAYNLAEFNTIGIVLFMQLPSPGNNLANLRMMMRAAHTLAEDLQGVILTEEQEIFDANAEQAYLARV

SEQ ID NO: 3701 - protein, 272 aa, H. influenzae strain 86-028NP
MLNLNELKSGFHYFVMGWHFITQKGLRRFVIIPILLNTILLCGLFWLFISQISSAIDWVMNFIPDWLSFLSVILLTLSILTILLLFYFTFTTFSGFIAAPFNGLLAEKVEKMLTEENINDDSLVDIMRDVPRMLAREWQKLRYSLPKIIALFLLSFIPLVGQTIVPVLTFLFTCWMMAIQYCDYPFDNHKVSFDIMKTALGNQRTQSLTFGGLVTCCTFVPVINLLIMPVAVCGATLMWVENYRNDLGFNMNRSFSSQTGLDVRSENTGIVK

SEQ ID NO: 3702 - protein, 316 aa, H. influenzae strain 86-028NP
MTIYADNSYSIGNTPLVRLKHFGHNGNVVVKIEGRNPSYSVKCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 3703 - protein, 346 aa, H. influenzae strain 86-028NP
MNILIIGPSWVGDMMMSHSLYQQLKIQYPNCNIDVMAPNWCKPLLARMPEVRKAIEMPLGHGAFELGTRYRLGKALRNQYDMAIVLPNSLKSAFIPAFAKIAVRRGWKGESRYFLLNDLRNNKRDYPMMVQRYVALAFEQNAVPKAADIPVLKPYLTVDPTQQAETLKNFKKQTALLGERPIIGFCPGAEFGPAKRWPHYHYAKLAEMLITQGYAVALFGSAKDEPVGEEIRQALPEALREFCVNLAGKTNLNEAVDLIANCTAVVTNDSGLMHIAAAVNRPLIALYGPTSPQYTPPLSDKATIIRLIEGGLIKVRKGDKEGGYHQSLIDITPEMALEKLNELLAK

SEQ ID NO: 3704 - protein, 387 aa, H. influenzae strain 86-028NP
MTEQYYKIALLFNANKVYDRQVVEGIGQYIQASQCMWDIFVEDEFIYHTDTINQLSIDGIIADFDDPKTVELLQHTLIPTIAVGGSYKQADFYPHFPYVATDNMALVEMALSHLQEKGLSQFAFYGLQVNTHKHWSIERRDAFVELMEKNHYPIYLYEGVQVHAQNWLEEQQKLIVWLKSLPSHTGIIAVTDARARHLLQACEYSKIAVPEELCVVGIDNEELIQYLSRMSLSSVEQGTREIGYQAAKLLHKLLNGQKVSHTPILIPPITVHSRNSTDYRSLTDPLVIQAMHYIRHRACHRIKVEQVLDHLETSRSNLEQRFKNEMNKTIHQVIHEEKISRAKNLLQQTDISIQEIAEICGYPSIQYFYSVFKKEFEMTPKEFRLNC

SEQ ID NO: 3705 - protein, 468 aa, H. influenzae strain 86-028NP
MKTTHRTRMPTTLEAFSPIIVMLLLLGLGYALFDLPAEPLMIISTVFAGFLVIKLGHCYLDILDAISEKIAKTMPALLILITVGLLIGTWISGGTIPMMIYYGLKAISPEYLYVTALFLTAIVSICTGTSWGSAGTVGVAFMGVAIGLDANLAATAGAVVAGAYFGDKLSPLSDTTNIASAAAGVDLYEHIVHLLYTTLPSFILSATVYVVYGLNYDFSNVATPEKVNTMIHELEQVYHFNFLLLIPVAIVLWGSITKKPTIPVMLLSAFIAIINAILIQKFSLSDVINSAVNGFDTSMIHHTSVSSDLSRLLNRGGMNSMMGTLLICFCALSFAGVLQLSGALTVIIQKLLTFVHSTLSLIITTILCGLTMIGVTCNGQISILIPGEMLKNAYVEKGLHPKNLSRTAEDSATIIEPILPWTAAGAYMAGTLGVATLSYLPWAILCWSGIIFAIIYGASGIGIAKLKK

SEQ ID NO: 3706 - protein, 390 aa, H. influenzae strain 86-028NP
MNNFYNFDVIIDRLNTFSAKWNVDNDIIPMSVADMDIPAPQIMIDELEKFNRLGIYGYTELPADYYKIISDYIFEQYHYSVLSEKIVFCPRIIQAVSIYIRAFTKENDGICILSPSYSPILNTIKLNDRKLYQCPLVYENRKYHIDFHLLEECFKHSKVFVLISPHNPTGTIWNKEVLIKIINLAKKHNVFIISDDVHADFTLTNDSHYLISSLDEWVANHSMICLSPAKTFNIPGLEIANLIIENKEIREKFIKEMMALGIHNPNYFSIPAIISLYKYCTDWVIYLKEYIKNNKKIVKEFFNEYIPLLDITESDGTYLLWINYKKLSINENELAYWINNLSRVKVSLGSEFGKEGDGFFRMNVAMPRKKLLEALNRIKNGFCLLNNREI

SEQ ID NO: 3707 - protein, 439 aa, H. influenzae strain 86-028NP
MTTYFDKIEKISFEGEKSTNPFAFKHYDANQVILGKTMAEHLRLAVCYWHTFCWNGNDMFGLGSLERSWQKNPNVLAGAEQKADIAFEFLNKLGVPYYCFHDVDIAPEGNSVREYVQNFHHIVDILERKQVETGVKLLWGTANCFTNPRYMSGAATNPNPEVFAWAATQVFNAMNATQRLGGENYVLWGGREGYETLLNTDLKREREQIGRFMQMVVEHKHKIGFKGTLLIEPKPQEPTKHQYDYDVATVYGFLKQFGLEKEIKVNIEANHATLAGHTFQHEIATACALDIFGSIDANRGDPQLGWDTDQFPNSVEENTLVMYEILKHGGFTTGGFNFDAKIRRQSIDPYDLFYAHIGAIDVLALSLKRAAKMLQEKTLQKIVNARYAGWNSELGQHILQGKTSLETLAQLVQQKDLAPKPVSGQQEYLENLVNQVIYS

SEQ ID NO: 3708 - protein, 511 aa, H. influenzae strain 86-028NP
MKQKCGCISPHFFILGDIMYIGIDCGTQGTKAIVLDSVQKKVIGVGYAKHELITQSNGRREQQPNWWIEALQQALQIALKQAKNSPHFSPNLVKGIGISGQQHGLVMLDKNDRPLYKAKLWCDTETATENDILIEKLGGQTAVFEKLGIICQTGYTASKLSWFRQNYPDKFANIRKIMLPHDYLNYWLTGKFCTEFGDASGSGYFDVVKREWKREVFKYLAPELNMDEVLPKLLSAEQKIGVIKPEIATLFGFNENVIVSTGGGDNMMGAIGTGNIREGIATMSLGTSGTLYAYTQKPLLNLPPMIANFCSSNNGWLPLVCVMNITSSNKQLMNLLNIDIEELNQLAQQAPIGANGITILPFFNGERVPPLPNAKASILGLDSSNFTRENLCRAMMESATFTLRYGLDLFRQAGLETSQIRLIGGGAKSSFWRQMIADVMNSEVVCLQEEEAAALGGAIQAMWANGEGELEFLCETFIHLDENSKAYPNLSQVKNYQSAYERYLIHLSQLY

SEQ ID NO: 3709 - protein, 308 aa, H. influenzae strain 86-028NP
MIIVTGGAGFIGSNIVKALNDLGRKDILVVDNLKDGTKFANLVDLDIADYCDKEDFIASIIAGDEFGDIDAVFHEGACSATTEWDGKYIMHNNYEYSKELLHYCLDREIPFFYASSAATYGDTKVFREEREFEGPLNVYGYSKFLFDQYVRNILPEAKSPVCGFRYFNVYGPRENHKGSMASVAFHLNNQILKGENPKLFAGSEGFRRDFVYVGDVAAVNIWCWQNGISGIYNLGTGNAESFRAVADAVVKFHGKGEIETIPFPEHLKSRYQEYTQADLTKLRSTGYDKPFKTVAEGVTEYMAWLNRK

SEQ ID NO: 3710 - protein, 167 aa, H. influenzae strain 86-028NP
MKIKKLLKNGLSLFLTFIVITSILDFVRRPVVPKEINKITLQDLQGSTFSLDSLDQNKPTLLYFWGTWCGYCRYTSPAINSLANEGYQVVSVALRSGNEADVNDYLSKHDYHFTTVNDPKGEFAERWQINVTPTIVLLSKGKMDLVTTGLTSYWGLKVRLFFAEFFG

SEQ ID NO: 3711 - protein, 223 aa, H. influenzae strain 86-028NP
MTSNQLAQYIDHTALTAEKNEQDISTLCNEAIEHGFYSVCINSGYIPLAKEKLAGSNVKICTVVGFPLGANLTSVKAFETQEAIKAGANEIDMVINVGWIKSQKWDAVKQDIQAVFNACNGTPLKVILETCLLTKDEIVKACEICKEIGVAFVKTSTGFNKGGATVEDVALMKQTVGNIGVKASGGVRDTETALAMIKAGATRIGASAGIAIISGTQDTQSTY

SEQ ID NO: 3712 - protein, 509 aa, H. influenzae strain 86-028NP
MSLAIVYSRASMGVQAPLVTIEVHLSNGKPGFTLVGLPEKTVKEAQDRVRSALMNAQFKYPAKRITVNLAPADLPKEGGRFDLPIAIGILAASDQLDASRLKQFEFVAELALTGQLRGVHGVIPAILAAQKSKRELIIAKQNANEASLVSDQNTYFAQTLLDVVQFLNGQEKLPLATEIVKESAVNFSGKNTLDLTDIIGQQHAKRALTIAAAGQHNLLFLGPPGTGKTMLASRLTGILPEMTDLEAIETASVTSLVQNELNFHNWKQRPFRAPHHSASMPALVGGGTIPKPGEISLATNGALFLDELPEFERKVLDALRQPLESGEIIISRANAKIQFPARFQLVAAMNPSPTGHYTGTHNRTSPQQIMRYLNRLSGPFLDRFDLSIEVPLLPQGSLQNTGDRGETSVQVREKVLKVREIQMERAGKINAYLNSKEIERDCKLNDKDAFFLEKALNKLGLSVRAYHRILKVSRTIADLQGEQQISQPHLAEALGYRAMDRLLQKLSNM

SEQ ID NO: 3713 - protein, 205 aa, H. influenzae strain 86-028NP
MSEIKLNYHKTHFLTSAPNIRSIPEDTGIEIAFAGRSNAGKSTALNALTNQKNLARTSKTPGRTQLINLFEVEPNCKLVDLPGYGYAAVPEQMKIQWQKSLGEYLQKRECLAGLVVLMDIRHPLKDLDQQMIEWAVSANLPVLLLLTKADKLSQSARSKQVKMVREAILPFQGDIQVEAFSAQNKIGIDKLAAKLDFWFSPLFAK

SEQ ID NO: 3714 - protein, 292 aa, H. influenzae strain 86-028NP
MAIQMTTKTTYQWPQSKDIYPYRPGRFDAPKHWRYNLRSFLNRGSIRRFEQFINQYPFLVDIFNTHLDYSYPVACRFLDKRFNASQRFHAVCENLLFLPEKLTALSTPLWEKPLSFGEVIPDFEMTLSMTTHQPMEGYWVLELWHKPRNELVYLLTFAKLGDALLIAVVQGPNFEGSKEMVKQLTKLCHGLRPAYLMVETMKSLTKILGYDKLLGIPQKYQNKSRFIQSKQYTVDYDAIFGESGGELKDYWELPLEMDRNLDDIPSKKRSMYRKRYAMLDDLAKVIEEKLGL

SEQ ID NO: 3715 - protein, 332 aa, H. influenzae strain 86-028NP
MTVSNNKELLLEVNHLGVSFKIKNDKSLFFAKPQTLKAVKDVSFKLYAGETLGVVGESGCGKSTLARAIIGLVEASEGEILWLGKHLRKQSAKQWKETRKDIQMIFQDPLASLNPRMNIGEIIAEPLKIYQPHLSAAEVKEKVQAMMLKVGLLPNLINRYPHEFSGGQCQRIGIARALIIEPKMIICDEPVSALDVSIQAQVVNLLKSLQKEMGLSLIFIAHDLAVVKHISDRVLVMYLGNAMELGSDVEVYNDTKHPYTKALMSAVPIPDPKLERNKSIELLEGDLPSPINPPSGCVFRTRCLKADENCAKQKPPFTSQNNSHFVACLKVL

SEQ ID NO: 3716 - protein, 323 aa, H. influenzae strain 86-028NP
MNPLLDVKNLYVRFKTPDGVVTAVNDLNFTLNAGSTLGIVGESGSGKSQTAFALMGLLAANGEVEGSAIFEGKELVNLPNAELNKIRAEQISMIFQDPMTSLNPYMKIGEQLMEVLQLHKGYDKQTAFAESVKMLDAVKMPEAKKRMGMYPHEFSGGMRQRVMIAMALLCRPKLLIADEPTTALDVTVQAQIMTLLNELKHEFNTAIIMITHDLGVVAGICDQVMVMYAGRTMEYGTAEQIFYHPTHPYSIGLMDAIPRLDGNEEHLVTIPGNPPNLLHLPKGCPFSPRCQFATEQCQIAPKLTTFNHGQLRNCWLSAEKFNL

SEQ ID NO: 3717 - protein, 311 aa, H. influenzae strain 86-028NP
MTDYRTQPINQKNADFVEQVADRIEEMQLEGRSLWQDAKRRFFRNKAAVVSLIILAFIIIFITVAPWFFPFTYEDTDWNMMSSAPTMEGYHFFGTDASGRDLLVRTAIGGRISLLVGIAGAFISVTIGTIYGAISGYVGGKTDMLMMRFLEILSSFPFMFFVILLVTLFGQNIFLIFIAIGAIAWLGLARIVRGQTLSLKNKEFVEAAIVCGVPRRQIILKHIIPNVLGLVAVYASLEVPGLILFESFLSFLGLGTQEPMSSWGALLSDGAAQMEVSPWLLIFPAFFLCLTLFCFNFIGDGLRDALDPKDR

SEQ ID NO: 3718 - protein, 306 aa, H. influenzae strain 86-028NP
MLKFIFKRLLEALPTLFILITFSFFLMRLAPGSPFTSERAYPPEVMANIEAKYHLNEPLYKQYFLYLENLSKGDFGPSFKYKDQSVNDLIASAFPVSIKLGMVAFAFAVVLGVTAGTLAALNQNSRWDYILMSFSMLGVIMPSFVFAPVLVLIFAIYLGWLPAGGWNGGTAMYMILPVASLTIAYVAGIARIMRGSMIEVLHSNFIRTAKAKGLSMSRIILKHALRPALLPVITYLGPAFVGIITGSMVIESVFGLPGMGLLFVNGALNRDYSLVLSLTILVGALTILFNAIVDILYAIIDPKIRY

SEQ ID NO: 3719 - protein, 541 aa, H. influenzae strain 86-028NP
MQHKLLFSAIALALSYSVQAVIVPEGTQLDEKQHIVINNGAEPQSFDPHKTEGVPESNVAYQLLEGLVTSDSEGKLQPGAAESWENTPDFKTWTFHLRKDAKWSNGDPVTAHDFVFAWRRLVDPATAAPYASYLSYLQVENAQDIIDGKKKPAELGVEAKDDYTFVVHATNPVPYAVSLTTHQSLLPLPQKVVEKLGDAWVKKENYVGNGAYKLANHIINEKIEFERNPLYWNDKETVINSATFLAIENPSTDVARYRAGDLDMTSYGLPPEQFAKLKKELLGEVYVTRTLGTYSYELNNKKAPFDNVNIRKALNLSLDRNVITDKVLGQGQTPTYVFTPTYIEEGHLIQQPAYSKEPMAQRNEEAIKLLEEAGYSKANPLKFSILYNTNENHKKVAIAAASMWKANTKGLIDVKLENQEWKTYIDSRRAGRYDVARAGWHADYNQATTFGNYFLSNSSNNTAKYANPEYDKAMAESYAATDAEGRAKAYAKAEEILGKDYGIVPIFNYVNPRLVKPYVKGYSGKDPQDHIYLRNLYIIKH

SEQ ID NO: 3720 - protein, 317 aa, H. influenzae strain 86-028NP
MTTQLDSLRNMTVVVADTGDIDAIKKYQPQDATTNPSLILSASALPQYAPLIDEAVAYAKAQSNDKAQQLIDAEDKLAVNIGLEILKIVPGRISTEVDARLSYNTQATVEKARKLIALYNAAGISNDRILIKIASTWQGIRAAEILEKEGINCNLTLLFSEAQARACAEAGVYLISPFVGRILDWYKANSDKKEYAPAEDPGVISVTKIYNYYKEYGYNTVVMGASFRNVGEITELAGCDRLTIAPALLKELQENSTALIRKLEYKGEVKAKPQPLTEAEFYWQHNSDAMAVEKLAEGIRKFAIDQEKLETMLSAKL

SEQ ID NO: 3721 - protein, 533 aa, H. influenzae strain 86-028NP
LRSLPMLWFFFCVAVLIIGYFIYGKIIEKIFVINPKRQTPAYQVNDGVDYMPMSKTKIWLIQLLNIAGTGPIFGPILGALYGPVAMLWIVIGCIFAGAVHDYFCGMLSIRHGGATMPYLAGKFLGRPVKVFINTLALVLLLLVGVVFVASPAQLMGTITMDVFGASQSALVLGDAEAVHHSVEAGGIKVWGMDKATVVALWTAIIFAYYILATLLPVDKIIGRIYPLFGALLLFMSVGMVYGLVVSHFSATDPIEFFRTINADGEGLTWAKFTQNFQVKGDVPIWPLLFLTISCGALSGFHATQTPLMARCTENESEGRFIFYGAMITEGVIALVWCMVGLAFYENPQALQDAISAGSPSKVVYDSSLHFLGFIGGIFAILGVIVLPITSGDTAFRAARLQIAEIFNVDQRSLPKRLLIAVPLFVLGYFISTIDFSVLWRYFTWANQMTAMVMLWTTAGYLYRYHKFHWVASLPAWFITTVCATYLFYNKIGFGLDYQLSVYLGLATTIVCIVLFFTMLKPLGTRDEEAYINN

SEQ ID NO: 3722 - protein, 151 aa, H. influenzae strain 86-028NP
MFRGATAVNLDSKGRVAIPTRYRAEILEKNQGQMVCTVDIRQSCLLLYPLDEWEKIEQKLLALSNFDPTQRRLQRVMLGHATECEMDAQGRILLSGPLRQHAKLEKGLMLVGQLNKFEIWSDVEWHTQIAEDIEIGSSTDFAADALNDFSL

SEQ ID NO: 3723 - protein, 321 aa, H. influenzae strain 86-028NP
MNSENSFSSSEHITVLLHEAVNGLALKENGIYIDGTFGRGGHSRFILSQLSSNGRLIAVDRDPRAIAEAHKIQDLRFQIEHNSFSHIPEICDKLNLVGKIDGILLDLGVSSPQLDEAERGFSFMKDGPLDMRMDTTQGLSAEEWLKQVSIEDLTWVLKTFGEERFAKRIATAIVDFNKSAVKNSTEFLSRTSQLAELISQAVPFKDKHKHPATRSFQAIRIFINSELDELESLLNSALDMLAPEGRLSIISFHSLEDRMVKHFMKKQSKGEDIPKGLPLREDQIQRNQKLRIIGKAIQPSDAEIQANPRSRSAILRVAERI

SEQ ID NO: 3724 - protein, 107 aa, H. influenzae strain 86-028NP
MSENNKPRYPLQQILVEDLFSSNKLVVLLLIGILVSAMGTIWITHKTRQLISENGMLILQRQALENEYRNLQVQEATEGDSTRVESIAISTLKMKVVSSEQEVEIRE

SEQ ID NO: 3725 - protein, 610 aa, H. influenzae strain 86-028NP
MVKFNSSRKSGKSKKTIRKLTAPETVKQNKSQKVFEKCFMRGRYMLSTVLILLGLCALVARAAYVQSINADTLSNEADKRSLRKDEVLSVRGSILDRNGQLLSVSVPMSAIVADPKTMLKENSLADKERIAALAEELGMTENDLVKKIEKNSKSGYLYLARQVELSKANYIRRLKIKGIILETEHRRFYPRVEEAAHVVGYTDIDGNGIEGIEKSFNSLLVGKDGSRTVRKDKRGNIVAHISDEKKYDAQDVTLSIDEKLQSMVYREIKKAVSENNAESGTAVLVDVRTGEVLAMATAPSYNPNNRVGVKSELMRNRAITDTFEPGSTVKPFVVLTALQRGVVKRDEIIDTTSFKLSGKEIVDVAPRAQQTLDEILMNSSNRGVSRLALRMPPSALMETYQNAGLSKPTDLGLIGEQVGILNANRKRWADIERATVAYGYGITATPLQIARAYATLGSFGVYRPLSITKVDPPVIGKRVFSEKITKDIVGILEKVAIKNKRTMVEGYRVGVKTGTARKIENGHYVNKYVAFTAGIAPISDPRYALVVLINDPKAGEYYGGAVSAPVFSNIMGYALRANAIPQDAEAAENTTTKSAKRIVYIGEHKNQKVN

SEQ ID NO: 3726 - protein, 488 aa, H. influenzae strain 86-028NP
MKKLTALFNLPELKNDIELHNMVLDSRKVKAGDLFVAIKGHQVDGNQFIDSALHSGASAVVSETELSSEHLTVAFIRNVPVVKYYQLARHLSSLADVFYDSPSKNLTLVGVTGTNGKTTISQLLAQWAELLGHRAAVMGTIGNGLLGQIVEAKNTTGSAVEIQSSLSTFKHAGADFTSIEVSSHGLAQHRVEALHFKAAIFTNLTRDHLDYHQSMENYAAAKKRLFTELDTQIKVINADDEIGYQWLTELPDAIAVSMNADFKVGSHQWMKAINIHYHFKGADITFESSWGNGVLHSPLIGAFNVSNLLLVMTTLLSFGYPLENLLATAKSLKGVCGRMEMIQYPNKPIVIVDYAHTPDALEKALIAAREHCQGELWCIFGCGGDRDRGKRPLMAQVAEQFAEKIIVTKDNPRTEPQSQIEADIVAGFKNMEKVGIIPDRAQAIQFAIESAVENDVILIAGKGHEHYQIIGSEVVHFSDQEIALDFLK

SEQ ID NO: 3727 - protein, 457 aa, H. influenzae strain 86-028NP
MIKLSTVQLAQILQAKLIGDENVQVEEINTDTRKSVSNSLFFALKGEKFDAHQYLDQAVSQGALALVVQQENSSILVPQLVVKDTRIALGELAKWLREKINPRTVAMTGSSGKTTVKEMTASILQHTAADSEAVLFTNGNFNNDIGVPLTLLRLTEKHRFAVIELGANHQNEINYTTKLVQPNAALINNIAPAHLEGFGSLAGVVQAKGEIYRGLTKNGVAIINAEHNHLDIWQKEISNHAIQYFNGKDYSVKNVQGNEQGSTFTLVSPQGEIDISLPYLGEHNVKNALAATALAMNVGATLADVKAGLEQRSQVKGRLFPIQVTPNLLLLDDTYNANKDSLCAAIDVLKSYDAFLILCVADMKELGENSLAIHREVGQYVNLVNLDLVCSYGNESAVISEAVLGKHFTDKTEMVDFLVPLIENQLQQNKKVVVLGKGSRSMKMEDVIYSLKDKIKC

SEQ ID NO: 3728 - protein, 360 aa, H. influenzae strain 86-028NP
MLVWLAEYLVRYETAFNAISYITVRAILALLTALFISLWIGPKVIKRLQILKFGQEVRNDGPESHFAKKGTPTMGGVMILFSIGVSTLLWANLANSYIWVCLFVLFGYGAIGFVDDFRKITRKNTDGLIARWKYFWMSVVALVAILWLYWLGHDTDATRLVIPFFKDIMPQLGLFYIVLSYFVIVGTGNAVNLTDGLDGLAIMPTALVAGAFALIAWATGNVNFAEYLHIPYIKYSSEVVVFCTAIVGASLGFLWFNTYPAQVFMGDVGSLALGGALGVVAILVRQEFLLVIMGGVFVVEALSVILQVGSYKLRKQRIFRMAPIHHHFELKGWPEPRVIIRFWIISLMLVLMGLVTLKLR

SEQ ID NO: 3729 - protein, 437 aa, H. influenzae strain 86-028NP
MNAYQNKNITIIGLGKTGLSCVDYLLSQQANIRVIDTRKKPTGIDKLPQNIPLHTGSLNQEWLLESDMIVISPGLAVKTPEIQTALKAGVEVIGDIELFCRAATKPIVGITGSNGKSTVTTLVYEMAKAAGVKVGMGGNIGIPALSLLNEDCELYVLELSSFQLETTYSLKAAAATVLNVTEDHMDRYMDLEDYRQAKLRIYHNAEVGVLNNEDKLTFGEGENQARQTVSFAENSADYWLKTENGKQYLMVKDEVILPCEEVTLVGRHNYMNILAATALAQAVGINLDSIRTALRHFKGLDHRFQLVHQANGIRWINDSKATNVGSTVAALAGLYIEGKLHLLLGGDGKGADFSELAELINQPHIICYCFGRDGVQLAKFSSQSYLFETMEQAIEFLRPTLQSGDMVLLSPACASLDQFASFEKRGEEFTHLAQYSA

SEQ ID NO: 3730 - protein, 394 aa, H. influenzae strain 86-028NP
MEFLQNIKKNYDEWTRITPQGLLYDRALFWLFVILLLIGLVAVTSASIPYSSRLFNDPFYFAKRDAIYVLLSLLTCYISLQISSSQWEKWHAKIFLFSVILLLLVPFIGTSVNGAKRWISLGILNFQPAEFAKLALTCFLASYFTRRYDEVRSRHVSIFKPFIVMLVLGCFLLLQPDLGSTVVLFIIMSGMLFIVGAKILQFVGLIALGGILFVWLVLTASYRLKRFIGFLEPFKDPYGTGFQLTNSLIAFGRGEITGEGLGNSIQKLDYLPEAHTDFIMAIIGEEFGFIGILIVILLLGLLIFRAMKIGRESLMLEQRFRGFFALGIGFWIFFQGFVNLGMALGMLPTKGLTFPLVSYGGSSIIIMSATIGILLRIDHENRLFRIGQARLRDD

SEQ ID NO: 3731 - protein, 351 aa, H. influenzae strain 86-028NP
MKNKKLLVMAGGTGGHVFPAIAVAQTLQKQEWDICWLGTKDRMEAQLVPKYGIPIRFIQISGLRGKGIKALLNAPFAIFRAVLQAKKIIQEEKPDAVLGMGGYVSGPAGVAAKLCGVPIILHEQNAIAGLTNKLLGKIATCVLQAFPTAFPHAEVVGNPVREDLFEMPNPDIRFSDREEKLRVLVVGGSQGARVLNHTLPKVVAQLADKLELRHQVGKGAVEEVSQLYGENLEQVKITEFIDNMAEAYAWADVVICRSGALTVCEIAAVGVAAIFVPFQHKDRQQYLNAKYLSDVDAAKIIEQADLTPEMLVNYLKNLTRENLLQMALKAKTMSMPNAAQRVAEVIKQYSN

SEQ ID NO: 3732 - protein, 475 aa, H. influenzae strain 86-028NP
MKHSHEEIRKIIPEMRRVQQIHFIGIGGAGMSGIAEILLNEGYQISGSDIADGVVTQRLAQAGAKIYIGHAEEHIKGASVVVVSSAIKDDNPELVASKQKRIPVIQRAQMLAEIMRFRHGIAVAGTHGKTTTTAMISMIYTQAKLDPTFVNGGLVKSAGKNAHLGASRYLIAEADESDASFLHLQPMVSVVTNMEPDHMDTYEGDFEKMKATYVKFLHNLPFYGLAVMCADDPVLMELVPKVGRQVITYGFSEQADYRIEDYEQTGFQGHYTVICPNNERINVLLNVPGKHNALNATAALAVAKEEGIANEAILEALADFQGAGRRFDQLGEFIRPNGKVRLVDDYGHHPTEVDVTIKAAREGWGDKRIVMIFQPHRYSRTRDLFDDFVQVLSLVDALIMLDVYAAGEAPIVGADSKSLCRSIRNLGKVDPILVSDTSQLGDVLDQIIQDGDLILAQGAGSVSKISRGLAESWKN

SEQ ID NO: 3733 - protein, 306 aa, H. influenzae strain 86-028NP
MNLKQEKIAVLLGGTSAEREVSFNSGKAVLEALLKQGYNAHPIDPKEYNVANLKKDGFNRAFNILHGRGGEDGTMQGLLEQIGLPYTGCGVMASALTMDKMRTKMLWKAFGLPVADMKVVTRETFSELDPQAVVAKLGLPLMVKPSLEGSSVGLTKVKAVEELKSAVEYALKFDNTILIEEWLAGDELTVPVLDNQVLPAIRIVPEGEFYDYEAKYISDNTQYFCPAGLTPEREQELAILVKRAYDALGCRGWSRIDVMCDAKGNFRLVEVNTNPGMTSHSLFPKSAATVGISFEQLVVKILELSL

SEQ ID NO: 3734 - protein, 254 aa, H. influenzae strain 86-028NP
MNILKRKTPQNIRFGEQKPKYYFHIRAFAVLLGVFFLLGVYFNWQSILEKMDDKPISAFALVGQNTFTTADDIKESLLKMGELKGFWGQDVAPIQEQIEALPWVKGAIVRKMWPNRLSIWVSEYQPVAFWNQNQFVTLDGIVFQLPSVRLTAKNLPYLGGPDYQSLKVIETWNQIYINLKSNNIMAKGINIDDRGAWQIQLDNDIVLKLGRGDWKSKLERFVTIYPQIDVPENKKIDYIDLRYTAGAAVGMVDR

SEQ ID NO: 3735 - protein, 425 aa, H. influenzae strain 86-028NP
MVKGVETKTIVGLEVGTSKVVAVVGEVFPDGVVNVLGVGSCPSKGIDRGSITDLDAVVGSIQRAIEAAESMADCQIMSVTLAITGEHIQSLNESGFVPIAESEVTQEEIDSALHTASSIKLPEGLSLLHVIPQEYAVDRQMNIKNPLGLQGVRLKAQVHLIACHQDWQNNLKKAVERCGLQVDKVVFSGFAATHSVLTEDEKDLGVCLIDFGAGTMNVMVYTNGALRFSKVIPYAGNIVTNDIAHACTISRAEAERIKVNYASAFYPARLHGDKKIEVASIGGRAPRSLTKSDLSLITSARYTELLGVVKDELDKLKAELEAKHIKFELIAGVVITGGGAQIEDLKECASNVFHCQVRIASPLNITGLTDYVNRPQYSTVVGLLQYNHSNSDDDLISGSDDSEGTFFESIWQGVKKIVNKVRSEF

SEQ ID NO: 3736 - protein, 421 aa, H. influenzae strain 86-028NP
MLYPEYPEYDNFNESGALIKVVGVGGGGGNAVNHMVMNMVKQEMGGTFVGESSLTSEEHGRIVFYAVNTDAQALRKSQVQQTVQIGGETTKGLGAGANPNIGRKAAEDDQDEIRKMLEGADMVFIAAGMGGGTGTGAAPVVAKIAKELGILTVAVVTKPFAFEGKKRMQFAELGIKDLSQYVDSMIIIPNQQIQKVLPKNAKLIDAFAAANDVLRNSVMGISDMITSPGLINVDFADVRTVMSVQGQAMIGFGSAVGEPGAGRAEEAARLAVRNDLLEKIDLSNAQGILVNITAGMDLVFDEFNIIGETIGSFASEEATVVVGTSLVPEMSDEIRVTIVATGLGEIAGNEPIQVVRQGLSTQNIEGEGRVNIVPELHRRESVEVSRSASEEYQRPLDKPITDRLEAFKKNNFFNPAQREEN

SEQ ID NO: 3737 - protein, 305 aa, H. influenzae strain 86-028NP
MIKQRTLKQSIKVTGVGLHSGNKVTLTLRPAMPNTGVVYYRTDLNPAVAFPADPNSVRDTMLCTALINDQGVRISTVEHLNAALAGLGIDNIIIEVDAPEIPIMDGSASPFIYLLLDAGIEEQNAAKKFIRIKEYVRVEDGDKWAEFKPYNGFRLDFTIDFDHPAIGKDVRNYEMNFSAQAFVHQISRARTFGFMKDIEYLQSQGLALGGSLDNAIVLDDYRILNEDGLRFKDELVRHKMLDAIGDLYMAGYNIIGDFKAYKSGHGLNNKLLRAVLANQEAWEFVTFEDKEQVPQGYVAPAQVLI

SEQ ID NO: 3738 - protein, 385 aa, H. influenzae strain 86-028NP
MALELSDIRQQITQIDRSLLKLLSERHRLAFDVVRSKEISQKSLRDVEREQQLLQELVQFAENENYQLEAQYITSIFQKIIEDSVLTQQVYLQNKLNEQRNQNLHIAFLGKRGSYSNLAARNYAARYQKQFVELGCQSFDQVFEKVQTGEADFGVLPLENTTSGAINEVYDLLQHTDLSLVGELAYPIKHCVLVNDKTDLSQIDTLYSHPQVIQQCSQFIHSLDRVHIEYCESSSHAMQLVASLNKPNIAALGNEDGGKLYGLSVLKTNIANQENNITRFIVVAKDPREVSSQIPTKTLLLMTTSQQAGALVDALLVFKKHQINMTKLESRPIYGKPWEEMFYLEIEANIHHPDTKQALEELKNYSNYLKILGCYPSEIVKPVSV

SEQ ID NO: 3739 - protein, 285 aa, H. influenzae strain 86-028NP
MEIIIISGRSGAGKSVALRALEDTGYYCVDNIPLDLLPQLTDILSQSQSSVAISLDIRNIPSSANSLEQTLSTLQKHHQIKIIFLEADRATLIRRYSDSRRLHPLSLKDLSLEAAIDEEYRYLEPLIQHANLILDTTHLSTHILAERLREFLRDNSEKELKIIVESFGFKYGIPLDADYVFDVRFLPNPHWDPTLRPMTGLEAPVAEFLNSHTEVNEFIYLTRHYIDTWLPMLEKNNRSYLTIAIGCTGGKHRSVYIAQQLGEYFQAKGKTVQIQHKSLERNKKI

SEQ ID NO: 3740 - protein, 164 aa, H. influenzae strain 86-028NP
MKITELLSSENIRQGVSFSSKKRLFESIAHFVEEQILAEQGEQACFECLFEREKLGNSGLGNGIAMPKAKIPVTVSDKAIAVFMQLDNPIDYDAVDSKPVDLIFALLIPENQCESYIPVLASLIEKLTDKNVLKQLRSAKSADEIWQVFEITDQSETTLEEVKE

SEQ ID NO: 3741 - protein, 241 aa, H. influenzae strain 86-028NP
MSILTAENLAKSYKSRKVVSDVSLTVNSNEIVGLLGPNGAGKTTTFYMVVGLVRQDQGKIVIDGEDISLLPMHNRAQRGIGYLPQEASIFRRLTVYENLMAVLEIRKDLTPQQRREKADELIEEFNISHIRDNLGQALSGGERRRVEIARALAANPKFILLDEPFAGVDPISVSDIKKIITDLRNRGLGVLITDHNVRETLDVCERAYIVGAGKIIATGTPAQVMNDEQVKRVYLGEQFKL

SEQ ID NO: 3742 - protein, 172 aa, H. influenzae strain 86-028NP
MKLVSNKILFLATMVLASSSAFALKDDVNQPINIVSDNQSLDMEKSVVTFTDNVVITQGSIIIKANKVVITRPAEKSGKKETVEAFGTPVTFHQQLDNGTPIDGKANKVHYDLGNEFLTLTNNAELKQLDSKINGSVITYDVKKQQLKANGNGKSRVTTVLIPSQLQQAKGK

SEQ ID NO: 3743 - protein, 202 aa, H. influenzae strain 86-028NP
MNIRWNVILGVIALCALAWFYSLNQETADLSELVKKPDSPDYVGYKMETTVFSPEGKKQYLALSDKIEHYTVNEQTLFTAPLVYLYPTTSNEKEQNPNQNVDFFSTQNWKLSANQARLTKDQILYLEGNVVVQSLTSDSRLQRIETESAVVNLKTQDMTSETQVKIKGKNFSSTGLKLVGNLRQQVATLKEQVKTYYEVSKQ

SEQ ID NO: 3744 - protein, 178 aa, H. influenzae strain 86-028NP
MAKRKKKEVFDWEDEDQEEIIWVSKSEIKRDAEDLKQLGEKIVNLTKANLAKIPLDESLLDAIELAQRLQKEARRRQLQYIGKLFRGIDVEPIREALDKIENKHNQQQAMLHKIEKVCDELVEKGDVALTDLLNDYPDGDRQQLRNLIRSAQKELEQNKPSKAYREIYQMLKVLMLED

SEQ ID NO: 3745 - protein, 451 aa, H. influenzae strain 86-028NP
MKTAENSTALLKAQEQELRQAVSFAVALATKAGASAEVAVTKVSGLSVSARLQEIENVEFTNDGALGISVYMGQQKGNASTSDLSESAIKNAVEAALAIAKYTSPDDCTGLADKDLMAFDAPDLELYHAADVDVDKATELALQAEKAALEADERIINSNGASFNSHTGVKVYGNSHGMLQSYLSSRYSLSCSVIGGVEAALENDYEYTISREFDKLQSPIWVGENCAKKVVSRLNPQKLSTREVPVIFLNDVATGLISHFAAAISGGSLYRKSSFLLDHLGKQVLPDWFNISERPHLLRRLASTPFDSEGVRTQDREIVEGGILQTYLVTSYSGKKLGMPSTGHAGGIHNWLVKPNLTGGLTALLHQMGTGLLVTDVMGQGVNIVTGDYSRGASGFWVENGEIQYPVAEITIAGQLQDMLKNMVAVADDIEHRSNIQTGSILLDKMKISGN

SEQ ID NO: 3746 - protein, 179 aa, H. influenzae strain 86-028NP
MKKHHVDVLISENDVHARIAELGAQITKFYQEKQIDSLVVVGLLRGSFMFMADIVRQINLPVEIEFMTTSSYGTGMTTNHDVRITKDLDGDIKGKHVLIVEDIIDTGYTLEKVRDILNLREPASLAICTLLDKPSRREVEVLVEWVGFEIPDEFVVGYGIDYAQRHRNLGYIGKVVLEE

SEQ ID NO: 3747 - protein, 440 aa, H. influenzae strain 86-028NP
MLLVNLAIFIAFLLLLAQLYRKTEKLGQTVFIGLLLGLLFGAVLQSAFEKPLLDETLDWINVVGNGYVRLLQMIVMPLVFVSILSAIARINQTRSLGKVSVGVLSTLLITTAISAAIGIAMVHLFDVSAAGLIVGDRELAAQGKVLDKAGQVSNLTVPAMLVSFIPKNPFADLTGANPTSIISVVIFSALLGVAALSLGKEDQALGERIAQGVETLNKLVMRLVRFVIRLTPYGVFALMIKMAATSKWADIVNLGNFIVASYAAIALMFVVHGILLFFVKVNPVDYYKKVLPTLSFAFTSRSSAATIPLNIETQTAKLGNNNVIANFAASFGATIGQNGCGGIYPAMLAVMVAPMVGIDPFSFSYILTLIFVVAISSFGIAGVGGGATFAAIVVLSTLGLPLELVGLLISIEPIIDMGRTALNVNGAMVAGTITDRLLNK

SEQ ID NO: 3748 - protein, 155 aa, H. influenzae strain 86-028NP
MNYLQYYPTDVINGEGTRCTLFVSGCTHACKGCYNQKSWSFSAGVLFDDAMEQQIINDLKDTRIKRQGLTLSGGDPLHPRNIETLLPFVQRVKRECPDKDIWVWTGYKLDELDEQQRAMLPYIDVLIDGKFIQEQADPSLVWRGSANQIIHRFKL

SEQ ID NO: 3749 - protein, 576 aa, H. influenzae strain 86-028NP
MRTLLPFIRLFKFAKFPLILGLVLMILGLGSSMGLLTVSGWFLAATAIAGLGTLFNFFYPSASVRGLAIGRTVMRYFEKIVTHDATFRILSKLRVQVFEKIIPLSPAVLNRYRNSDLLNRLVSDVDTLDSLYLRLLAPFFTAVFVIIAITIGLSFINIPLALGLGLFLLILLMIIPTVFYRLGQQFGERLIQARATYRTQFLEFIQAQAELLLFNAEDRLKEKMSATEKTWQEDQAKEAKLSGFSTALVLFLNGLLISGMLWFASNADFGTDEYRTAYIALFTFAALAAFEIIMPLGAAFLHIGQVIAAAERVTEIIEQKPIVEFNGNEEFETKVRLISAKNLNFSYPEQETLVLKNLTLDLEQGKKIAILGKTGSGKSSLLQLLVRNYDANQGELLLAEKPISAYSEETLRRQICFLTQRVHVFSDTLRQNLQFASADKISDEQMIEVLHQVGLSKLLEQEGKGLNLWLGDGGRPLSGGEQRRLGLARILLNNASILLLDEPTEGLDRETERQILRLILQHAENKTLIMVTHRLSSIEQFDKICVIDSGRLIEEGDYNSLITKENGFFKRLIERV

SEQ ID NO: 3750 - protein, 586 aa, H. influenzae strain 86-028NP
MNKLRQKYLQKWLRAQQEPIKKLMRANIVLATLSSFILVAQTYFLATLLDKLIMQNVPRDELIPYFLGLIIGFGMRAIILWAREKIGFQSGQLLRNHIRQKILDKIHLVGPATINQKPAGSWASIMLEQVENLHNFYARFLPQQSLSAIVPVVIFIAVFPLNWAAGLILMITAPLVPLFMIIVGIAAADNSQKNMDTLSRLSAQFLDRLRGLETLRLFNRTSEQTEHIENATEDFRETTMDVLKLAFLSSAVLEFFTSISIALMAVYFGFSYLGQIEFGTYNAPLTLFTGFFCLILAPEFYQPLRDLGTYYHDRAAGIGAADAIVDFLESDYLTVHQNEKTISLESAVEISAENLVVLSTQGSALTKPLNFQIPANHNVALVGQSGAGKTSLINAILGFLPYEGSLKINGQELRESNLADWRKHIAWVGQNPLLLQGTIKENLLLGNIQANDEEINQALMRSQAKEFTDKLGLHHEIKDGGLGISVGQAQRLAIARALLRKGDLLLLDEPTASLDAQSENLVLQALNEASQHQTTLMITHRIEDLKQCDQIFVMQRGEIVQQGKFTELQHQGFFAELLAQRQQDIQ

SEQ ID NO: 3751 - protein, 318 aa, H. influenzae strain 86-028NP
MSDIKHAKLLILGSGPAGYTAAIYAARANLKPVLVTGLQQGGQLTTTDEIENWPGDFEMTTGSGLMQRMLQHAEKFETEIVFDHINRVDLSSRPFKLFGDVQNFTCDALIIATGASARYIGLPSEENYKGRGVSACATCDGFFYRNKPVGVIGGGNTAVEEALYLANIASTVHLIHRRDSFRAEKILIDRLYKKVEEGKIVLHTDRTLDEVLGDNMGVTGLRLANTKTGEKEELKLDGLFVAIGHSPNTKIFQGQLELNNGYIVVKSGLEGNATATSVEGVFAAGDVMDHNYRQAITSAGTGCMAALDAERYLDAQEA

SEQ ID NO: 3752 - protein, 285 aa, H. influenzae strain 86-028NP
MADFPFIVEINEQNLTEILQQSLEKPLVINFYAPTHKESADFLVLLEQVAEQYQGQFILGKVDCEKEQMIAAQFRIQALPTTYLFKEAQALEAFPGMLDKASLIQRLSIILPKEEDLKFQQALDFLQVENYEAALPLLKDAWELSDKKNSDVALLYAETYIAMKKTEPAQEILNQIPLQDRDSRWHGLQAQIELQIQAADTPEIQQLQADYAKNPTAEIAIKLAVQLHQAGRNEEALTLLFGILKTDLSAQNGEVKQQFLSILSAMGNADPLTNKFRRLLYSLLY

SEQ ID NO: 3753 - protein, 323 aa, H. influenzae strain 86-028NP
MTKSAKIGVLLANLGTPDSPTPKSISRYLWQFLTDPRVVDLPRCKWYPLLKAIILPLRSKRIAKNYQAIWTEQGSPLLAISRQQKDALQAYLDTQNINAQVEIAMTYGNPSIQSTVKNLLKNQVERIIVLPLYPQYSSSTTGAVFDAFANALKEERGLVPFDFIHSYHIDENYINALANSIKVRLKSDEFLLFSYHGIPLRYEKMGDYYREHCKQTTIAVVNKLGLTENQWGMTFQSRFGREEWLQPYTDKFLESAATQNIQKIAVICPGFSVDCLETIEEIDKENRENFLTNGGQSYQYIPALNVEHTHIEMMGKLILEKLA

SEQ ID NO: 3754 - protein, 138 aa, H. influenzae strain 86-028NP
MIWQKNFTLENLNQLCSNSAVSHLGIEISAFGEDWIEATMPVDYRTMQPFGVLHGGVSVALAETIGSLAGSLCLEEGKTAVGLDINANHLRPVSSGKVTARATPINLGRNIQVWQIDIRTEENKLCCVSRLTLSVINL

SEQ ID NO: 3755 - protein, 1027 aa, H. influenzae strain 86-028NP; identical to SEQ ID NO: 652

SEQ ID NO: 3756 - protein, 359 aa, H. influenzae strain 86-028NP
MKKTAIALVVAGLAAASVAQAAPQENTFYAGVKAGQGSFHDGINNNGAIKQNLSSANYGYRRNTFTYGVFGGYQILNQDNFGLAAELGYDNFGRVKLREAGKPKAKHTNHGAHLSLKGSYEVLDGLDVYGKAGVALVRSDYKFYEVANGTRDHKKGRHTARASGLFAVGAEYAVLPELAVRLEYQWLTRVGKYRPQDKPNTAINYNPWIGSINAGISYRFGQGEAPVVAAPEMVSKTFSLNSDVTFAFGKANLKPQAQATLDSVYGEISQVKSAKVAVAGYTDRIGSDAFNVKLSQERADSVANYFVAKGVAADAISATGYGKANPVTGATCDQVKGRKALIACLAPDRRVEIAVNGTK

SEQ ID NO: 3757 - protein, 120 aa, H. influenzae strain 86-028NP
VIKCLPRLFIGNIMETLDKIKKQISENPILIYMKGSPKLPSCGFSARASEALMHCKVPFGYVDILQHPDIRAELPTYANWPTFPQLWVEGELIGGCDIILEMYQAGELQTLLAEVAAKHA

SEQ ID NO: 3758 - protein, 366 aa, H. influenzae strain 86-028NP
MQYINIANRGVKSLSPYQAGKPIEELEREIGISNIVKLASNENPFGFPESAKKAIFEQLDKLTRYPDANGFELKQTIAKKFGVQPNQITLGNGSNDLLELFAHTFATEGDEIIYSQYAFIVYPLVTKAINAIAKEIPAKNWGHDLQGFLTALSDKTKLIYIANPNNPTGNFLTSQEIEDFLAKVPENVIVVLDEAYTEFTRSEERVDSFSLLKKYSNLIISRTLSKAYGLAGLRIGYAVSNPEIADLLNRVRQPFNCNSLALTAAVAVMNDDEFIEKVAENNRIEMRRYEDFCQKNQLDYIPSKGNFITIDFKQPAAPIYDALLREGVIVRPIAGYGMPNHLRISIGLPEENDKFFTALSKVLKFA

SEQ ID NO: 3759 - protein, 362 aa, H. influenzae strain 86-028NP
MSQVFNFSAGPAMIFPEVLQKAQNELTNWLNQGVSVMEVSHRGKYFMELVTQAEKDLREVYNIPDNYRVLFLQGGARGQFAAIPMNLIGKKGKALYLNSGHWSATAAKEARNFAEIDEITIVENGEQTRITDLDFSHIADQYDYVHYCPNETISGVEIFDVPNVGNAVLVADMSSNILSRQIDISKFGIIYAGAQKNLGPAGITLVIIRDDLIGNARKETPSIWNYATQRDADSMINTPPTFAWYLCSLVFKHLKEIGGLEIIEKRNALKAQTLYDYIDSSKLYRNVVAKENRSTMNVTFITGNPELDAKFVAESTATGLQALKGHKVLGGMRASIYNAMSQNGVEALISFMKKFEAENLPQ

SEQ ID NO: 3760 - protein, 114 aa, H. influenzae strain 86-028NP
MEIVNKQSFQEVLEYVRMYRLKNRIKRDMEDNNRKIRDNQKRILLLDNLNQYIRDDMTIAEVRGIIESMRDDYESRVDDYTIRNAELSKQRREASTKMKEQKKAHAELLKNAEK

SEQ ID NO: 3761 - protein, 188 aa, H. influenzae strain 86-028NP
MYPLFETLCIENGKIQNIDLHQARYERSLREYYGKSAVKIFNLFSLIQLPEDLQNQLVRCRIDYNAETTQIQYFEYQRKIYRTFQPVICDDIEYSLKYLDRSLINTLFAQRGACDEIMIIKNGKVTDCSIGNLIFRQGKKWYTPDTPLLLGTQREKLLQEGKIQERTIFQEDIVNFDEIKIINAMNSL

SEQ ID NO: 3762 - protein, 328 aa, H. influenzae strain 86-028NP
MAQSTMQHFIEQANHYGKQRTPFFFLIDFEKEKPLICPLENSAQQGIYFDILGKRNCTISPQSLPLNFTKHPMPFSHYQQGFELVQSELQKGNSYLLNLTYPTEISGNLSLEQIFHQTNAPYKLWLQDQFVCFSPECFVNIHDNNIFTYPMKGTINATLPDAENQLLTNEKEQREHYTIVDLMRNDLSMVAEHIQVKKFRYIDRIKTQKGEILQTSSEIYGKSNENWQNQIGDILEKLLPAGSISGAPKEKTTQIIQQAEKQKRGYYTGIFGIFDGKTLQSAVAIRFISQVDEKFYFHSGGGITIHSNAQDEYEELLEKVYLPIEGAD

SEQ ID NO: 3763 - protein, 193 aa, H. influenzae strain 86-028NP
MKLLIINNHDSFTFNLVDLIRKLNVPYDVLNVEDLKESTAEKYSHILISPGPDIPRAYPQLFSMLEKYYQQKSILGVCLGHQTLCEFFGGTLYNLENVRHGQKRTLKVRSNSPLFFDLPTEFNIGLYHSWGVQEEDFPDCLEVTALCDEGVVMAMQHKSLPIYSVQFHPESYMSDFGEKILRNWLAIPPSTNP

SEQ ID NO: 3764 - protein, 384 aa, H. influenzae strain 86-028NP
MSSYLFTSESVSEGHPDKIADQISDAVLDEILKQDPKARVACETYVKTGMALVGGEITTSAWVDIENLTRKVICDIGYEHSEMGFDGHSCAVLNAIGKQSADINQGVDRENPLDQGAGDQGIMFGYATNETDVLMPAAITYAHRLMEKQAEVRKSGKLAWLRPDAKSQVTLKYEDNKIVGVDAVVLSTQHSEEVSQKDLHEGVMEEIIKPVLPTEWLSKETKFFINPTGRFVIGGPMGDCGLTGRKIIVDTYGGAARHGGGAFSGKDPSKVDRSAAYAARYVAKNIVAAGLADRCEIQLSYAIGVADPTSIMVETFGTGKVANELLVSLVREFFDLRPYGLIKMLDLIQPIYRETAAYGHFGREQFPWEKVDRAEDLRIAAGLK

SEQ ID NO: 3765 - protein, 171 aa, H. influenzae strain 86-028NP
MTSISLIPFRHLKMQVQRKLNQSLLLAEAYFKRKFTMPEVNYELRGIKAGVAYLQKNEIKFNRTLLQENTDEFIRQVVPHELAHLIVYQMFGRVKPHGKEWQLVMNEIFKLPADTCHQFDIKNVQGKTFEYRCACQTHFLTIRRHNKIMKENIEYLCKKCKGKLVFVDDEE

SEQ ID NO: 3766 - protein, 170 aa, H. influenzae strain 86-028NP
MKKSLLAVIVGAFAFASVANANIYAEGDIGLSQTKANGSNNTRVEPRVSVGYKVGNTRVAGDYTHHGKVDGTKIQGLGASVLYDFDTNSKVQPYVGARVATNQFKYTNRAEQKFKSSSDIELGYGVVAGAKYKLDGNWYANGGVEYNRLGNFDSTKVNNYGAKVGVGYGF

SEQ ID NO: 3767 - protein, 101 aa, H. influenzae strain 86-028NP
MEKLKTAANPNQAKIDNATKSYETAKNELVSTWKGTAGSVSVGNKIRGITRQITGIAAGTYRGQSAVAAGVRYTPKPNMVISLSGSADTNNGDCFKRSPLN

SEQ ID NO: 3768 - protein, 227 aa, H. influenzae strain 86-028NP
MFQEYLSVIVQGIPTSLLLTVVSLLIAFFLALFLTFLLSMENKWIKSAVNLYLTLFTGTPLLVQFFLIYAGPGQFQWIIDSPLWYVLSNAWFCAVLALALNSAAYSTQLFHGAVKAIPKGQWESCAALGLSRLQTLKILIPYALKRALPSYSNEIILVFKGTALASTITIMDIMGYARQLYGTEYDAITIYGIAGGIYLIITGIATLLLRKLEKKVLAFERFEVSKA

SEQ ID NO: 3769 - protein, 221 aa, H. influenzae strain 86-028NP
MFSDFLSLMFTAALMTLGLAVCSLLLGLFLSLIFAVLEANRFVGKPMTVFVALLRGLPEIIVVLLVYFGSTELVEILTGEYIEFGAFGCGVFALSLIFAAYASQTLRGAIQAIPKGQWESGAALGLSKSYTFIHIVMPQVWRHALPGLSNQWLVLLKDTALVSLIGVDDLIHQADLMNTNTHQPFTWYGIAALIYLAVTLISQVGIRKLELRFTRFERGMK

SEQ ID NO: 3770 - protein, 239 aa, H. influenzae strain 86-028NP
MKKTLLTAILLGSSIAVSAQELTFAMEPSYPPFETTNEKGEIIGFDVDVANAICQEIQATCKFKSETFDSLIPSLKAKRFDAAISAIDITDARAKQVLFSDAYYDSSASYVALKGKATLESAKNIGVQNGTTFQQYTVAETKQYSPKSYASLQNAILDLKSGRIDIILGDTAVLSDMISKEPEIQFIGEKVTNKKYFGNGLGIAMHKSNKDLAAQLNKGLAAIKANGEYQKIYDKWMTK

SEQ ID NO: 3771 - protein, 243 aa, H. influenzae strain 86-028NP
MAIRVKNLNFFYGSSQTLFDINLEAEEGDTVVLLGPSGAGKSTLIRTLNLLEVPKSGELSIANNDFNLSNAMANPKAIRQLRQDVGMVFQQYHLWPHLTVIENLIEAPMKVRGVSESEAKTDAMELLKRLRLEQLADRFPLHLSGGQQQRVAIARALMMKPQVLLFDEPTAALDPEITAQVVDIIKELQETGITQVIVTHEVNVAQKVATKVVYMEQGKIVEMGSADCFENPKTEQFKHYLSH

SEQ ID NO: 3772 - protein, 194 aa, H. influenzae strain 86-028NP
MYLDQIKAELVEAQDVLNKFISDENNIKLIQEAALLISNSFKQGGKVLSCGNGGSHCDAMHFAEELTGRYRENRPGYPAIAISDASHLSCVSNDFGYEYVFSRYVEAVGQKGDVLFGLSTSGNSKNILNAIEAAKTKGMKVIAMTGKDGGKMAGLADVEIRVPHFRYADRIQEIHIKVIHILMMLIEFEMAKQA

SEQ ID NO: 3773 - protein, 304 aa, H. influenzae strain 86-028NP
MIFCDLDRKNKFEWLDIFQDMFILRKLISPLIFKNTMKFYRTLLLFFASSFAFANSDLMLLHTYNNQPIEGWVMSEKLDGVRGYWNGKQLLTRQGQPLSPPAYFIKDFPPFAIDGELFSERNHFEEISSITKSFKGDGWAKLKLYVFDVPDAEGNLFERLAKLKAYLLEYPTTYIEIIEQIPVKDKTHLYQFLAQVENLQGEGVVVRNPNAPYERKRSSQILKLKTARDEECTVIAHHKGKGQFENVMGALTCKNHRGEFKIGSGFNLNERENPPPIGSVITYKYRGITNSGKPRFATYWREKK

SEQ ID NO: 3774 - protein, 327 aa, H. influenzae strain 86-028NP
MTNEVKENTPLLNAIGLKKYYPVKKGLFAKPQQVKALDGVSFQLERGKTLAVVGESGCGKSTLGRLLTMIEEPTKGELYYKGHNFLENDSETKALRRKKIQIVFQNPYASLNPRKKIGSILEEPLIINTKLSAKERREKVLSMMEKVGLRAEFYDRYPHMFSGGQRQRIAIARGLMLDPDVVVADEPVSALDVSVRAQVLNLMMDLQDELGLSYVFISHDLSVVEHIADEVMVMYLGRCIEKGTTEQIFSNPQHPYTKALLSATPRLSPNLRRERIKLTGELPSPINPPKGCAFNPRCWKATEKCRENQPHLEQYTDGKLIACFHID

SEQ ID NO: 3775 - protein, 330 aa, H. influenzae strain 86-028NP
MALLDVKELSVHFGDKKTPFKAVDRISYQVAQGEVLGIVGESGSGKSVSSLAIMGLIDHPGRVSAESLQFENTDLLTLESKAKRQLIGADVAMIFQDPMTSLNPAYTVGFQIMEALKTHEGGTKKARKDRTLELLKLVGIPDPESRIDVYPHQLSGGMSQRVMIAMAIACRPKLLIADEPTTALDVTIQAQIMELLLELQKKECMSLILITHDLALVAEAAERIIVMYAGQIVEEGTAKDIFREPKHPYTQALLRSLPEFAEGKSRLESLQGVVPGKYDRPTGCLLNPRCPYATEYCRQVEPQLHHIGSHKVKCHTPLNEQGNPVEYQGA

SEQ ID NO: 3776 - protein, 295 aa, H. influenzae strain 86-028NP
MSDTPLTFAPKTPLQEFWFYFKQNRGALIGLIFILIVALISILAPYIAPFDPTEQNRTALLLPPAWYEGGNPAYLLGTDDIGRDILSRIIYGTRISVFAGFIIVLLSCAFGTSLGLISGYYGGVLDTIIIRLIDIMLAIPNLLLTIVVVSILEPSLANATLAIAVVSIPSYVRLTRAAMMNEKNRDYVTSSKVAGAGILRLMFIVILPNCLAPLIVQMTMGISNAILELATLGFLGIGAKPPTPELGTMLSEARGFMQAANWLVTIPGLVILSLVLAFNLMGDGLRDALDPKLKQ

SEQ ID NO: 3777 - protein, 333 aa, H. influenzae strain 86-028NP
MFKFVFKRILMVIPTFIAITLITFALVHFIPGDPVEILMGERGLTAEVHQQMMHQLGLDLPLYQQYFHYIGNVIQGDFGASFRTQQPVLTEFFTLFPATAELAFFALFWSLLGGIILGTIAAVKKDSWISHTVTAASLTGYSMPIFWWGLILILYVSPQLGLPQGGRLDNEFWIDTPTGFMLIDSWLSGMPGAFENAVKSLILPAIVLGTVPLAIITRMTRSAMLEVLGEDYIRTAKAKGLSYTRIVIVHALRNALIPVVTVVGLIVGQLLSGAVLTETIFSWPGIGKWIIDAIQARDYPVLQGSVLIIATIIIVVNLTVDLLYGVVNPRIRH

SEQ ID NO: 3778 - protein, 727 aa, H. influenzae strain 86-028NP
MMDISELLDGLNDKQRKAVAAPLGNHLVLAGAGSGKTRVLTHRIAWLIAVENISEGSIMAVTFTNKAAAEMRHRIQSTLAKHAQHQLVGMWIGTFHSIAHRLLRAHHLDVGLPQDFQILDSEDQLRLIKRLLKLHNFDEKAFPPKQACWYINNKKDEGLRPNDIEDFNDRQEREWIKIYQIYQDTCDRAGLVDFAELLIRVYELFEKKPLILQRYQQRFQHILVDEFQDTNKIQYKWIKILSGKTGKVMIVGDDDQSIYGWRGAQIENIQKFLKDFKAETIRLEQNYRSTANILNSANELIANNSDRLGKNLWTEGEKGDPVGIYAAFNELDEAKFVASQIQDWVEHGGKLDDCAVLYRSNSQSRVIEEALIRCQIPYRIYGGMRFFERQEIKDALAYLRLINNRQDDAAFERVINTPTRGIGDRTLDILRNLTRERQITLWQAVQVATQENMLAGRASTALLRFQELINSLQLDTAEMPLFAQTDFVIKHSGLYEMYQQEKGEKGEVRIENLEELVTATREFIKPDNAEEMTELTAFLTHASLEAGEEQASPHQSCVEMMTLHSAKGLEFPRVFMVGVEEGLFPSFRSFEEPGRLEEERRLAYVGITRAQKKLTISYAESRRLYAKEERHLPSRFIAELPRECIQEIRLRGTVTRAMNLAKVGSLSNTSAVENEWKMGQKVKHEKFGFGTVINVEGSENNTRLQIAFQAQGIKWLIAHLAKLEKVR

SEQ ID NO: 3779 - protein, 211 aa, H. influenzae strain 86-028NP
MLMEKYHDFEPNFNIVEIFESLQGEGFNTGMPSVFVRFGKCNLDCPWCDTPYNNFKRWSVSQILEKVRSFSSKNIIITGGEPTIVPKIEYLLEQFKSDGYFLAIETNGLKAIPAQIDYIATSPKSLYAHKYEKRCIPFANEVRIVMDSNMPSFCELIEQKIKAKNYYLSPCEIDGKMNLLETITLLGQLNQRSNKPKWQLSLQTHKLIGIE

SEQ ID NO: 3780 - protein, 141 aa, H. influenzae strain 86-028NP
MFKISKEFSFDMAHLLDGHDGKCQNLHGHTYKLQVEISGDLYESGAKKAMVIDFSDLKSIVKKVILDPMDHAFIYDQTNERESQIATLLQKLNSKTFGVPFRTTAEEIARFIFNRLKHDEQLSISSIRLWETPASFCEYQE

SEQ ID NO: 3781 - protein, 227 aa, H. influenzae strain 86-028NP
MNIFNPNHDRKAIVIFSGGQDSTTCLFQAIAEYGKENIEAITFQYGQRHAIELEKARAIVQDLGIKQTLIDTSVMKAITHNALMDEQAHIEQKENELPNTFVDGRNALFLLYAAIYAKGQGIQDIITGVCETDFSGYPDCRDVFIKSMNVTLNLAMDYQFNIKTPLMYLTKAQTWQLADELGVLDYVQKHTHTCYEGIEGGCGKCPSCILRNKGLKKYLTQKGRKNV

SEQ ID NO: 3782 - protein, 47 aa, H. influenzae strain 86-028NP
MKKWLLIIAGALIISACANKDVYFNGAEGSHSGVKFDKDSRQWGLNQ

SEQ ID NO: 3783 - protein, 343 aa, H. influenzae strain 86-028NP
MKDLDWNNLGFSYIKTDYRFIAHWKDGKWDEGKLTTDNTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFYSETEVGPVTRRLYDELTGIQFGDIEAPEGWIVKVE

SEQ ID NO: 3784 - protein, 297 aa, H. influenzae strain 86-028NP
MYKRLPPLNSLKSFESAARYLSFTKAADELCVTQAAVSHQIKLLEEFLGIELFKRKNRSLELTELGKAYFVDINKILRRLNEATERLLTLKTDPHLNISVPQTFGIQWLVPHLSEFNQLYPQIEVRLTGVDQDEGLLNKEIDLAIYYGLGNWQNLQVDRLCEENLLILASPELLAENPIIQPEDLKKHTLIHIHTCDNWQAMANHLQLDDLNIQQGPLFSHTFMALQAAIHGQGIVLANRLLALQEIENGSLQAVLPTNLPDPKSFYVVNHLDRLDDQKIQAFRQWIINSIKQEENE

SEQ ID NO: 3785 - protein, 363 aa, H. influenzae strain 86-028NP
MNKLALYCRPGFEKEVAAEITDQASHLGVFGFARVQDNSGYVIFECYQPDEADRLARDIPFNRLIFARQMMVISDLLEDLDPADRISPIVAAFEELSQQVNFAQSSELFVETADTNEAKELSTFCRKFTVPLRQALKKQGWLSAKASQKCGQFLHCFFVKPNCCYVGYSYVDNHSSHFMGIPRLKFPADAPSRSTLKLEEAILTFIPRKEENKRLNENMIGVDLGACPGGWTYQLVKRGLFVYAVDHGKMAASLHDTGCIEHCAEDGFKFQPPKRKKVDWLVCDMVEQPSRISLLIGKWLLNGWCRETIFNLKLPMKKRYQEVILCLENLAVMLAEQNLNFDIQAKHLYHDREEITVHIALKP

SEQ ID NO: 3786 - protein, 389 aa, H. influenzae strain 86-028NP
MNLHEYQAKQLFEHYGLPVKNGAVCQSVEDVDLVLAQLSGDKWAAKCQVHAGGRGKAGGVKLVQDVEEARAFAEKWLGQRLVTFQTDKLGQPVNQIYFEETCDIDKEFYLSAVVDRASQKVMFIASPAGGMNIEEVAQNSLHLLHKVEIDPLFGGLPYQGRELAFKLGLSGTQNKQFTDIFMGLSRLFLEKDLSLVEVNPLVLTKQGYLVCLDAKISVDDNALFRHKDLLALQDLTQNDAREAEAEKFQLNYVALEGDIGCMVNGAGLAMGTMDIVKLYGGKPANFLDVGGGATKERVAEAFKIILTDPSVKVILVNIFGGIVRCDLIAEGVIAAVNEVGVRVPVVVRLEGTNAEMGRQILAQSDVNILTAQSLQQAAELAVNAAKGEH

SEQ ID NO: 3787 - protein, 293 aa, H. influenzae strain 86-028NP
MAILIDKNTKVICQGFTGGQGAFHSEQALAYGTQLVGGVSPNKGGTTHLGLPVFNTVREAVENTGATATVIYVPASFCKDAIIEAIDAGIQLIVCITEGIPTLDMLKVKQKLNETGVVMIGPNCPGVITPDECKIGIMPAHIHKKGKVGIVSRSGTLTYEAVKQTTDEGFGQSTCVGIGGDPIPGSSFIDILERFQQDPETEAIVMIGEIGGSAEEEAAIFIKDNVTKPVVAYIAGITAPKGKRMGHAGAIISGGKGTAVEKIAALEAAGVTCVKSLAEIGEALRKLLKSSKN

SEQ ID NO: 3788 - protein, 207 aa, H. influenzae strain 86-028NP
MSQFFYIHPENPQARLINQAVEILQKGGVIVYPTDSGYALGCMMGDKHAMDRIVAIRKLPEGHNFTLVCSDLSELSTYATVNNTAYRLIKNNTPGRYTFILTATKELPRRLMTSKRKTIGLRVPDNKIALDLLSALGEPILSCSLMLPNEEHTTQSDPEEIRDRLEHQVDLIIHGGYLGQEPTTVVDLTEESPVILREGSGSTAPFI

SEQ ID NO: 3789 - protein, 357 aa, H. influenzae strain 86-028NP
MKPSQKQTQRQPHFSKDSAKKRDFSAKNDRRSVSRTARIETANTKKSAVNSDNKFLSKPKAKPVVRASNQPKAEGEKLQKVLARAGQGSRREIETMIAAGRVSVEGKIATLGDRIDVHSGVKVRIDGQIINLSHAQKEICRVLMYYKPEGELCTRSDPEGRATVFDRLPRLTGSRWIAVGRLDINTSGLLLFTTDGELANRLMHPSREVEREYSVRVFGQVDDAMLARLRKGVQLEDGPANFKEIKFTGGVGINQWYDVTLMEGRNREVRRLWESQGIQVSRLIRIRYGNIKLMKGLPRGGWEEMDLENVNYLRELVGLPAETETKLDVKQASRRPKSGQIRKAVKRYSEMNKRYKK

SEQ ID NO: 3790 - protein, 323 aa, H. influenzae strain 86-028NP
MKMHQLRYIVEIVNQNLNVTEAANALYTSQPGISKQVRLLEDELGLEIFERHGKHIKSITPAGKKIISIARELLVKAQGIRAVADEYTRPNHGVLRIATTNTQARYMLPSVIERFSKKYPDVSLHIHQGSPTQIHDALMSGEVDLAITTEAPYLFDDLVQIPCYWWNRAVIVSPEHPLAKVKELTIEELGKYPLVTYTFGFTGVSDLDYAFNSAGILPNIVFTATDADVIKTYVRLGLGVGIMASMAHTALDADLVLIDASHLFRPSMTNIAFKHSTFLRNYMYDFMEYFSPHLIRSVVEKAERLRDNNSVKKLFEGIELETR

SEQ ID NO: 3791 - protein, 314 aa, H. influenzae strain 86-028NP
METSHNQELVATILEDNVANELQTIQDFLRWTYSILNRSDIYFGQGHDNPWDESLQLVLSGLHLPIDLPTELFNSRLTPSEKETLVQLVLTRIEQRIPVAYLTNSAWFCGHEFYVDERTIIPRSPISALIQDRFEDLISQEPNHILDLCTGSGCIAIACAYAFPNAEVDAVDLSVDALNVAEINISRHQLEHRVFPIQSNLFENILGQKYDLIVTNPPYVDEEDLADMPEEFHFEPELALGSGSDGLNITKQILKQAPDYLTENGVLVCEVGNSMISLIEQYPDVPFEWVELKNGGLGVFAIQRKDLVKYHDLF

SEQ ID NO: 3792 - protein, 167 aa, H. influenzae strain 86-028NP
MQDEFDLFRAETKGIKPMKQDTFVAPHQKRDQKKIELKELRAKEDTLFYFSDEYEPLLNEHDGVVKYLRDGEDSHLLKQLRRGDFSPELFLDLHGLTREQAKQELAALLLACENEHIDCASIMTGYGTFTLKKQIPRWLVQHPKVRALHQAPREWGGEAAILILVDL

SEQ ID NO: 3793 - protein, 711 aa, H. influenzae strain 86-028NP
MSRTIILIPVSTGVGLTSISLGLIHSLEQKGTKVAFMKPVSQPSTGEDKLDRTTSIIRTSTSLETAEPFMLSVAESLIGQNQSDVLLEKIVANHQQLTKNNDIVVVEGLIPTRKHGYANNINYEIAQALDAEIVLVAAPATETPTELKDRVEAAASLFGGKNNPNLLGVVVNKFNAPVDESGRTRPDLAEIFDSFQHNHISETEVNKLFAGSAIKLLACVPWNANLIATRAIDLVKHLGASIINEGEINRRIRGITFCARSLPNMVEHFRAGSLLVASADRPDVLVAAALAASNGIEIGGILLTGGYKIDAQINKLCQPTFEKAKLPIFRIEGNTWQTALSLQSFNLEVPVDDKERIENIKQYISQHFNADFINNLVADSSRLPRLSPPAFRFQLTELARAAKKRIVLPEGDEPRTIKAAVLCAERGIAECVLLADPASVQRVAEAQGVKLGKGITIINPADVRENYVDRLVELRKAKGMTETAAREQLEDTVVLGTMMLEANEVDGLVSGAVHTTANTIRPPMQIIKTAPGSSIVSSIFFMLLPDQVLVYGDCAVNPDPTAEQLAEIAIQSADSAKAFGIDPKVAMISYSTGTSGSGADVEKVKEATRIAKEKRPDLLIDGPLQYDAAVMEDVARSKAPNSPVAGKATVFVFPDLNTGNTTYKAVQRSADLVSIGPMLQGMRKPVNDLSRGALVDDIVYTIALTAIQATQ

SEQ ID NO: 3794 - protein, 401 aa, H. influenzae strain 86-028NP
MSKLVLILNCGSSSLKFAILDPATGEEKLSGLAEAFFLPEARIKWKLNGEKGNADLGAGAAHTEALNFIASNILTDELKNSIAAIGHRIVHGGEKYTQSVIVTDEVVKGIEDAAQFAPLHNPAHLIGIREAFNAFPHLKDKNVVVFDTAFHQTMSEEAFLYALPYSLYKEHGVRRYGAHGTSHYFISREVAEYVGKPADQVNAIICHLGNGGSVSVVRNGQCIDTSMGLTPLEGLVMGTRCGDIDPAIVFYLYKTLGMSMEQIEETLVKKSGLLGLTEVTSDCRYAEDNYDNASKPEAKRALNVYSYRLAKYIGAYMAVLGDDHLDAIAFTGGIGENSAHVRELALNHLKLFGIKIDNERNLAARFGKDGVITTDDSAFKAIVLPTNEELVIAQDTARLCF

SEQ ID NO: 3795 - protein, 147 aa, H. influenzae strain 86-028NP
MAFFSIFKQGQIYLNTWPQEAKLGIIFPENRIMKATSFAQKFMPFVAVFAILWQQIYAKNDLMAFSIAILTALFALLIPFQGLYWLGKRANSPLENQSAVWFYDICERLKQQNEPLPFVQEKPTYQHLAEVLRKAQSKFERAFWQEI

SEQ ID NO: 3796 - protein, 163 aa, H. influenzae strain 86-028NP
MIDYIIIGIIAFSILVSLLRGFVREVLSLGSWVVAFIVASQFYPYLATYLTQIESMYVRNGTAIAILFVLTLIVGAIVNYVISQLVDKTGLSGTDRVLGAAFGLVRGALIVAALLFFMDTFTNFEQTDWWKESQLIPHFGFIIEWFFQQLQSSSSFLNPTLNQ

SEQ ID NO: 3797 - protein, 505 aa, H. influenzae strain 86-028NP
MCGIVGIVSQSPVNESIYAALTLLQHRGQDAAGIVTVDDENRFRLRKANGLVSDVFRQEHMLRLQGNAGLGHIRYPTAGSSSVSEAQPFYVNSPYGVTLVHNGNLTNSVELKEKVFKTARRHVNTNSDSELLLNILANHLDHIPQNHLDPQDIFYAVRKTHNDIRGAYACVAMIIGHGMVAFRDPFGIRPLVLGKREENGKTDYMFASETVALDIVGFEFVRDIAAGEAVYVTFDGELYSQQCTESAVLNPCIFEYVYFARPDSTIDGVSVYAARVHMGEKLGKKIAKEWADEIDNIDVVIPIPETSTDIALQIARVLGKPYRQGFVKNRYVGRTFIMPGQAQRISSVRRKLNTIKAEFKDKNVLLVDDSIVRGTTSEQIVEMARSAGAKKIYFASAAPEIRYPNVYGIDMPSCDELIAYGRNVEEIAHLIGVDKLIFQDLTALTESVQLENPAIQGFDCSVFTGEYITGDISPEYLDKIALQRNDSAKKKREKQASNLEIYNEQ

SEQ ID NO: 3798 - protein, 296 aa, H. influenzae strain 86-028NP
MNILLTGGTGLIGKALVEQLCLRNEQVTILTRSSSPHTLSKQKNIKFITALSELDLQEQFDAIINLAGEPIFHKVWSKNQKSILRESRLSLTTQLVEFINQYQQYPIFISGSATGIYGDQGEQKITETSKTAKTFTAQLCQDWENIAQQANARVCLIRTGMVFSTKGGALAKMLPLYKWGLGGKLGNGEQYFPWIALEDMVNGILFLLDHSECQGSFNFTAPNPIKQHKFNRTLAGILKRPAFATIPKWILHFILGERANLLLESQNVVPEKLLNAGFQFQYSDCKNYLEEILKNK

SEQ ID NO: 3799 - protein, 151 aa, H. influenzae strain 86-028NP; identical to SEQ ID NO: 648

SEQ ID NO: 3800 - protein, 311 aa, H. influenzae strain 86-028NP
MKVAVLGAAGGIGQALALLLKLQLPAGTDLALYDIAPVTPGVAVDVSHIPTAVNVKGFSGEDPTPALEGADVVLISAGVARKPGMDRSDLFNINAGIVRGLIEKVAITCPKACVGIITNPVNTTVAIAAEVLKKAGVYDKRKLFGVTTLDVLRSETFVAELKGLNVSRTSVPVIGGHSGVTILPLLSQVQYAKWNEDEIEPLAKRIQNAGTEVVNAKAGGGSATLSMAQAAARFARSLVKGLSGETVVECTYVEGDGKYARFFSQPVRLGKEGVEEILPIGPLSNFEQQALENMLPTLRADIELGEKFING

SEQ ID NO: 3801 - protein, 502 aa, H. influenzae strain 86-028NP
MSEQEVKELDLNGEMLVRREKLAALRAKGNAFPNKFRRDALAQDLHNQYDSEDGEILKEKSIEVQVAGRIMTRRAMGKATFITIQDMSSKIQLYVARDNLPEGVYKDDVGTWDLGDIVGVKGTLFKTKTDELTVKTTEVQLLTKALRPLPDKFHGLTDQEVRYRQRYLDLISNEESRRTFIIRSKVVAGIREYFISKGFMEVETPMLQVIPGGASARPFVTHHNALDVDMYLRIAPELYLKRLVVGGFERVFELNRNFRNEGVSVRHNPEFTMLEYYQAYADYHDLMDNTEELLRKLAIDILGTTIVKYGEYEFDFGKPFERITLHDATVKYGADKGIVKEDLYDFDRAKATAERLGIEVQKSWGLGSIVNAIFEEVAEHHLIQPTFLMAHPAEISPLARRNDENPDVTDRFELFIGGREIGNGFSELNDAEDQNERFDAQVAAKEAGDDEAMFKDEDFVVALEHGLPPTAGEGLGIDRLAMLYANAPSIRDVILFPAMRQK

SEQ ID NO: 3802 - protein, 283 aa, H. influenzae strain 86-028NP
LLELAIEAEDEDTFNEAVAELDELEQQLEKLEFRRMFSGEHDACDCYVDLQAGSGGTEAQDWTEMLLRMYLRWAESKGFKTELMEVSDGDVAGLKSATIKVSGEYAFGWLRTETGIHRLVRKSPFDSNNRRHTSFSAAFVYPEIDDDIDIEINPADLRIDVYRASGAGGQHVNKTESAVRITHMPSGIVVQCQNDRSQHKNKDQAMKQLKAKLYELELQKKNADKQAMEDNKSDIGWGSQIRSYVLDDSRIKDLRTGVENRNTQAVLDGDLDRFIEASLKAGL

SEQ ID NO: 3803 - protein, 229 aa, H. influenzae strain 86-028NP
MKKIFTALLCVAAANAMADDAAIKRKLQSFNVSNIAIKSSPISGIRTAVTDQGILYVSEDGKYLFEGKLYELTNNGPVDVAGKILVDKLNSYKDEMIVYPAKNEKHVVTVFMDITCHYCHLLHQQLKEYNDLGITVRYLAFPRAGMNNQTAKQMEAIWTAKDPVFALNEAEKGNLPKEVKTPNIVKKHYELGIQFSVRGTPSIVTSTGELIGGYLKPADLLRALEETAQ

SEQ ID NO: 3804 - protein, 575 aa, H. influenzae strain 86-028NP
VKKLIKRREIPVGNSVSNHPLLDRLYRARHIKNTKELDRTLKSMLNPNQLYGIDQAVNLLVEAYQQQQKIVIVGDFDADGATSTALSVLALRQLGFSDVDYLVPNRFEQGYGLSIPVAEMAIEKGVQLLMTVDNGVSSFDGVAFLKEKGIRVLVTDHHLPPETLPPADAIVNPNLSQCHFPSKSLAGVGVAFYLMLAVRAKFRELGIFTAETQPNFTDLLDLVALGTIADVVPLDQNNRILAYQGLMRIRARRCRPGIVALAEVANRNVEQFTSSDLGFCIGPRLNAAGRLDNMSIGVELLLANEMSKARELALDLDQLNQTRKEIEAGMKLEAIKICQNLTALFKELPYGITLYQPDWHQGVLGIVSSRIKDQYHRPVIAFAQDSEGILKGSARSIEGLHMRDVLERIHSQHPNMILKFGGHAMAAGLSIREEHFADFQHIFNQTVADWLDEEHMQSIIWTDGELNSNEFNLETAELIKSVGTWGQEFPEPCFDGEFKILDQRAIGQNKNHLKMLLEPKQGGVLLDAIAFNINTRLYPDLSIKQARLAYKLDINEFRGNRSLQLLVDYIEPIDE

SEQ ID NO: 3805 - protein, 235 aa, H. influenzae strain 86-028NP
MSDRMKLKGILAFCLLFLSSFVLAEVNQKEFSVQNSPHLPSRDTIYFEDGRDYFSYKEPIEQVSRADKKIRIQFFFDYDCRVCSSAQDILELYSQIRTYKVVLEQYPIATADSQFSARIFYTLQALSASELSNVLLFETSEKSRYTELSTSNKIQQWAEEQGLDKQLFIQTENSQSVKEQIQNAIELTEEYGVFTYPYVVIGGKYVLTASTLYNDDYSVAVLDFLVNKIEQEQKQ

SEQ ID NO: 3806 - protein, 230 aa, H. influenzae strain 86-028NP
MKIGIVGAMAQEVEILKNLMADRTETRVASAVIFEGKINGKDIALLQSGIGKVAAAIGTTALLQLAKPDCVINTGSAGGVAKGLKVGDIVISDETRYHDADVTAFGYEKGQLPANPAAFLSDKKLADLAQEMAEKQGQSVKRGLICSGDSFINSEDKIAQIQADFPNVMGVEMEATAIAQVCYAFNVPFVVVRAISDGGDGKASMSFEEFLPLAAKQSSALVLGMIDRLS

SEQ ID NO: 3807 - protein, 915 aa, H. influenzae strain 86-028NP
MKKAIKLNLITLGLINTIGMTITQAQAEETLGQIDVVEKVISNDKKPFTEAKAKSTRENVFKETQTIDQVIRSIPGAFTQQDKGSGVVSVNIRGENGLGRVNTMVDGVTQTFYSTALDSGQSGGSSQFGAAIDPNFIAGVDVNKSNFSGASGINALAGSANFRTLGVNDVITDDKPFGIILKGMTGSNATKSNFMTMAAGRKWLDNGGYVGVVYGYSQREVSQDYRIGGGERLASLGQDILAKEKEAYFRNAGYVLNDAGQWTPDLSKNAWSCNEDPPRLAENIENVKCTHYSFDPRKNDRKEILKKLKAGTKPENIDELQNGKDGIKETDKSFERNKDQYSVAPIEPGSLQSRSRSHLLKFEYGDDHQNLGAQIRTLDNKIGSRKIENRNYQVNYNFNNNNYLDLNLMAAHNIGKTIYPKGGFFAGWRVADKLITKNVANIVDINNSHTFLLPKEIDLKTTLGFNYFTNEYSKNRFPEELSLFYNDDSHDQGNYSNLGRFRGNRNLLPQRSVILQPSGKQKFKTVYFDTALSKGIYHLNYSVNFTHYAFNGEYVGYENTANQINEPILHKSGHKKAFNHSATLSAELSDYFMPFFTYSRTHRMPNIQEMFFSQVSNAGVNTALKPEQSDTYQLGFNTYKKGLFTQDDVLGIKLVGYRSFIKNYIHNVYGVWWRDGVVPTWADSTGFRFTIAHQNYQPIVKKSGAELELNYDMGRFFANVSYAYQRTNQPTNYADASSRPNNASKEDILKQGYGLSRVSMLPKDYGRLEIGTRWFDQKLTLGMAARYYGKSKRATIEEEYINGSHFELKTSGKRTYYVVKKTEEIKKQPIILDLHVSYEPIKDLIIKAEVQNLLDKRYVDPLDAGNDAASQRYYSSLNDSICSKSQDCEDGGKDKTVLYNFARGRTYILSLNYKF

SEQ ID NO: 3808 - protein, 532 aa, H. influenzae strain 86-028NP
MLSFILSIFPIVLLIYLMVKRNALPSYVALPWIATLVMGVHLLHFNTDIVTISANVVSAIIAVQTPITVIFGAILFNRFSEISGATNIMRKWLGNINPNPVAQLMIIGWAFAFMIEGASGFGTPAAIAAPILVGLGFHPLKVAMLALIMNSVPVSFGAVGTPTWFGFGALKLSEDMILEIGSITAFIHSIAALIIPLLALRILVNWDDIRKNIVFIYISVLGCVVPYFLIAQVNYEFPSLVGGAIGLFISVWAANRNIGLAKVTNTLDNNAVSTGEVVKALFPTGLLIAFLIVTRIHQLPFKAMMNDATIWFSTTLGSLGLFEISKGLIFSLKNIFGSNVSSSYKLLYVPALIPFVITVLIAIPVFKISSSNVKQIFVSSLQQSKNPFIALVGALVMVNLMLVGGEHSMVKIIGRTFAEISGSNWTIFSSFLGAIGSFFSGSNTVSNLTFGSVQLSTAETTGISVALVLALQSVGGAMGNMVCINNIVAVSSVLNISNQEGTIIKKTIIPMIIYGIIAALGALFLVPLFYNL

SEQ ID NO: 3809 - protein, 334 aa, H. influenzae strain 86-028NP
MKTLSEFIVERQAEYPNAKGELSGILSSIRLLAKIIHRDINKAGLTNILGQSGIENVQGESQMKLDLFAHNTMKAALMAREEVAGFASEEEESFIAFDTERGRNAKYIILTDPLDGSSNIDVNVSVGTIFSIYRRVSPIGSPVTLEDFMQPGNKQVASGYIVYGSSTMLVYTTGHGVNGFTYDPSIGTFCLSHENMQMPKEGKIYSINEGQYLKFPQGVKKYIKYCQEEDKATHRPYVSRYIGSLVADFHRNLLKGGIYIYPSATNYPNGKLRLLYEGNPIAFLAEQAGGVATDGYRRILDIEPTALHERVPLFVGSEDMVKKAQEMMEEFKEE

SEQ ID NO: 3810 - protein, 269 aa, H. influenzae strain 86-028NP
MKIALGIEYNGQNYYGWQRQEKVRSVQEELEKALSHIANEKIEIFCAGRTDSGVSGTGQVVHFETNAVRPEKAWAFGTNAHLPDDIAVAWAKQVDDEFHARFSATARRYRYILYCNKLRSAILAGGITHCHLDLDAEKMHQAGQCLLGEQDFSSFRAAQCQSHTPWRNVHHLNVSRIGKYIIVDIQANAFVHHMVRNIVGSLIEVGAGNQPIEWMQWLLEQKNRQLAAPTAKPDGLYLVDVIYPQKFDIPKRPIGPLFLEDGLLNRTLK

SEQ ID NO: 3811 - protein, 338 aa, H. influenzae strain 86-028NP; identical to SEQ ID NO: 719

SEQ ID NO: 3812 - protein, 269 aa, H. influenzae strain 86-028NP
MPLLQVEDLTKTFKGHASLFGRNQFNAVDKVSFTLERKQTLAIIGNNGSGKSTLVKMIAGIIPPTSGRILFNDRELQYQDAQSRAKHIRMVFQDANSAFNPRLNIGQILDEPLSLATDWTETQRNEKIFETLSLVGLYPDYTNLNIKHLSISQKQRVALARALILAPEIIIIDDAIGNLDASVRIQLLNLTLDLQQRLGISYIYVGQDLGVIKHIADTIIVMDDGKMIEYGSPQNLFTDPQTDVTRRLVESYFGKILDETAWVKDKNTH

SEQ ID NO: 3813 - protein, 349 aa, H. influenzae strain 86-028NP
MALLDICNLNIEIQTSNGRIKIVDGVNLSLNEGEISGLVGESGSGKSLIAKVICNAIKENWIITADRFRFHDIELLKLSPNKRRKIVGKEISMIFQNPLSCLDPSRKIGKQLIQNIPNWTFKNKWWKWFGWKKRRAIELLHRVGIKDHRDIMASYPNELTEGEGQKVMIAMAVANQPRLLIADEPTNTLESTTALQVFRLLSSMNQNQGTTILLTSNDIKSISEWCDQISVLYCGQNTESAPTEILIESPHHPYTQALINAVPDFTQPLGFKTKLGTLEGTAPILEQMPIGCRLGPRCPFAQKKCMEKPRRLKIKQHEFSCHYPINLREKNFKEKTTATPFILNCKGNE

SEQ ID NO: 3814 - protein, 295 aa, H. influenzae strain 86-028NP; identical to SEQ ID NO: 749

SEQ ID NO: 3815 - protein, 321 aa, H. influenzae strain 86-028NP
MFWSVLRHILWVALLLLVLSLLGFVILLRDPLNANLVTQNIYIGYFHYLGTLLQGDFGITYNGGKSLMNLILTVLPPTLELCFITLFLAFIFGLPLGIISAVNSEQVFAKSLQILSYVGLSIPIFWLAPILLYVAALSHWEIAAIGQYNLLYEIKPITGFPVIDMWFMEVPYRTKIVQNILQHLALPTLVLCILPTMEIIRIIHQRAEYILNQNFSKVATTRGWSKWKILHQYVFRNTFPLLVPQVPRVFTLVLTQCMLVETALGWPGIGRWLINAVNEQDYNSIAAGVIVIGVCIILIDTFTKIFTFILDPFKKKGWYAR

SEQ ID NO: 3816 - protein, 564 aa, H. influenzae strain 86-028NP; identical to SEQ ID NO: 618

SEQ ID NO: 3817 - protein, 470 aa, H. influenzae strain 86-028NP
MFNRVQKEINQIINRGFDRTLRLAVTGLSRSGKTAFITSLINQLLSINQHSSQNLPLFEAARNGAILAVKRVSQQDLSVPRFDYESNLNDLSQNPPQWFQSTRGVSETRLAIRFQRQSGLLRHLKERGTLYLDIFDYPGEWLIDLPLLNLDFQQWSQEQIKVTTGIREELAENWLAMLQDLDLSAVANEDVLAKIAKSYTDYLHQCKVQGMQFIQPGRFVLPSDLEGTPALQFFPLIHLSEEQWRTLKKTAKSNSYFAVLTKRYDYYRNKIVKGFYENYFSTFDRQVILADCLTPLNHSQQAFLDMQMGLNQLFNNFHYGSRNFLHRLFSPRIDRLMFVATKADHITRDQIPNLVSLMRQIVQEGGRHVEFEGIDTEYTAIAAVRTTKQVIVNQQGKEIKAIQGVRSIDKQLITLYPGTVPSKLPRAEFWQKQPHFDFDSFEPQPLEQGESIPHLRMDAVLQFLLSDRFE

SEQ ID NO: 3818 - protein, 879 aa, H. influenzae strain 86-028NP
MTQEYSTLRNNISMLGRFLGETINDAQGEDILELIENIRKLSRNSRAGDDKARQALLDTLGSISNENIIPVARAFSQFLNLTNIAEQYQTISREHSLAQSSSQSLSELFKRLKEQNASVEEVHKTVEKLLIELVLTAHPTETTRRSLIHKHIEINKCLSKLEHHDLTEKERNIIERLLLRLIAEAWHTNEIRTVRPTPFDEAKWGFAMLENSLWQAVPEFLRQLNETAREFLGYDLPVGLKPVRISSWMGGDRDGNPFVTAQITKKVLYFARWKAADLFLQDISKLADELSMMKCSDEFRDKYGEHLEPYRFVVKNLRNQLTATLAYFDDHLSNRTPRVSESEIILEDNQLWEPLYDCYQSLIQCGMRIIANGSLLDILHRISCFGVTLSQMDIRQESTRHTDAIAEIMRYIGLGDYSQWMEDDKQAFLIRELSSRRPLIPQNWTPSPETKEILDTCKVIAQQKQGVIACYVISMARSASDVLAVHLLLKEAGVPYHIPVVPLFETLEDLDAAEKVMTQLFNVGWYRGVINNRQMVMIGYSDSAKDAGMMAASWAQYRAQEALVNLTEKLGIELTLFHGRGGTIGRGGAPAHAALLSQPPRSLKNGLRVTEQGEMIRFKLGLPAVAVETFDLYASAILEANLLPPPEPKPEWRTIMDELSTISCDIYRGVVRGDKDFVPYFRSATPEQELSKLPLGSRPAKRNPNGGVESLRAIPWIFAWMQNRLMLPAWLGAGAAIRQVIEQGKGDIIHKMCENWPFFSTRIGMLEMVFSKSDTWLSQQYDQRLVKKELWYLGENLRKQLEDDIQTVLSLSHQSELMSDLPWIADSIALRNIYTDPLNLLQVELLHRFRENPEQVNPDVEQALMITITGIAAGMRNTG

SEQ ID NO: 3819 - protein, 336 aa, H. influenzae strain 86-028NP
MATIKDVAKMAGVSTTTVSHVINKTRFVAKDTEEAVLSAIKQLNYSPSAVARSLKVNTTKSIGMIVTTSEAPYFAEIIHSVEEHCYRQGYSLFLCNTQNDPEKVKNHLEMLAKKRVDGLLVMCSEYTQDSLDLLSSFSTIPMVVMDWGPNANTDVIDDHSFDGGYLATKHLIECGHKKIGIICGELNKTTARTRYEGFEKAMEEAKLTINPSWVLEGAFEPEDGYECMNRLLTQEELPTALFCCNDVMALGAISALTEKGLRVPEDMSIIGYDDIHASRFYAPPLTTIHQSKLRLGRQAVNILLERITHKDEGVQQYSRIDITPELIIRKSVKSIL

SEQ ID NO: 3820 - protein, 297 aa, H. influenzae strain 86-028NP
LLARLKYGKTNAVLFTTYIGSSMSNLQAIIEAAFEKRAEITPKTVDAETHAAIEEVIEGLDSGKYRVAEKIAGEWVTHQWLKKAVLLSFRINDNQIIDGAETKYYDKVALKFADYTEERFTEEGFRVVPSATVRKGAYISKNCVLMPSYVNIGAYVGEGTMVDTWATVGSCAQIGKNVHLSGGVGIGGVLEPLQANPTIIGDNCFIGARSEVVEGVIVEDGCVISMGVFIGQSTKIYDRETGEIHYGRVPAGSVVVSGSLPSKCGKYSLYCAVIVKKVDAKTLGKVGINELLRSIEE

SEQ ID NO: 3821 - protein, 432 aa, H. influenzae strain 86-028NP
MGKSVVILGAQWGDEGKGKIVDLLTDRVKYVVRYQGGHNAGHTLIINGEKTVLRLIPSGMLHPNVTCLIGNGVVVSPEALMKEMGELESRGIKVRERLLISEACPLILPYHVAMDHAREAALGKKAIGTTGRGIGPAYEDKVARRGLRVGDLFNKEAFAEKLKNILEYYNFQLVNYYKVEPVDYQKTLDDVMAIADVITGMVADITTILDTARKNGEHILFEGAQGTMLDIDHGTYPYVTSSNTTAGGVATGSGFGPRNLDYVLGIIKAYCTRVGGGPFTTELFDDVGAEIARKGNEFGAVTGRPRRCGWFDAVAIRRAIQLNSISGFCMTKLDVLDGFDEVKICVAYKMPNGEIVEYAPLAAKDWEGVEPIYETLPGWKENTFRITDVNKLPQNCINYIKRIEEVTGVPIDILSTGPDRVETMILRDPFAA

SEQ ID NO: 3822 - protein, 121 aa, H. influenzae strain 86-028NP
MPHLSVAKFGGTSVANYNAMTACAKIVIADPNTRVVVLSASAGVTNLLVALVNGVKATEREKLIGNDLHITSGVAKRIFDTVQSYNVRMISYGASTNNVCMLVQSEHSDEIVRSLHKSLFE

SEQ ID NO: 3823 - protein, 95 aa, H. influenzae strain 86-028NP
MAFKFNAEVRTAQGKGASRRLRNNGQIPAIVYGGSEEPVSIILNHDELNNAQAHESFYSEVITLVIGGKEVAVKVQAMQRHPFKPKLVHIDFKRA

SEQ ID NO: 3824 - protein, 218 aa, H. influenzae strain 86-028NP
VNQFFITSINIIKKQEQMEFLIGFFTEYGYWAVLFVLIICGFGVPIPEDITLVSGGVIAGLYPENVNSHLMLLVSMIGVLAGDSCMYWLGRIYGTKILRFRPIRRIVTLQRLRIVREKFSQYGNRVLFVARFLPGLRAPIYMVSGITRRVSYVRFVLIDFCAAIISVPIWIYLGELGAKNLDWLHTQIQKGQIVIYIFVGLLVLFFFWKWKKSKKSTQ

SEQ ID NO: 3825 - protein, 138 aa, H. influenzae strain 86-028NP
MENWTNEIWVAIGIAFIVGLFIGYIIVRLTKGSVKHQAKTEAELKTVKTQLDTQKAQIEKHFAESAELFKTLINDYQKLYRHYATSSNNLLGEKDHKGLFTQQLITATDKSQNEQPRDYSDGASGLFKENKEENKEEN

SEQ ID NO: 3826 - protein, 116 aa, H. influenzae strain 86-028NP
MTIQRILPNARLSEVSIHNNLAYFAGQVPELTIEQNTYEQTKEVLGLIDKLLAEIGSNKSNILTAQIFLADMQDYVQLNQAWDEWVDHVSPPSRATVEAKLADPRWKVEIVIIATC

SEQ ID NO: 3827 - protein, 238 aa, H. influenzae strain 86-028NP
MKLLISNQHGAIVMALLPFIYGMLLANPVWAHMFLLLGWFSLYLMTYPFLNLFKGKNLELYKKWSVIYFAAAVIFAIPALIYNWQVLYFMFAMLPFVAVNIYFTKKKDERNLWNDLAGILIFALAGMGSYYFSDRTFDEKILWVAIYPTLFFIGTTLYVKSMMRERKNPRYFWASVIFHLLCVLIFVVSQQFILALAFVPGLVRAVYLPTKKLSVMQVGLTEFAITAVFFILLLVATL

SEQ ID NO: 3828 - protein, 180 aa, H. influenzae strain 86-028NP
MKLKLFFHIVLLCFSLPVWAMKTIDITANSKMDDQARMNLAQEFANKQQWSSVFDIMYPMALEGNTTAQSNLGMLYNLGRGTVRDYEKAYWWFSEAAEKGSVKGLNNLGVMYLRGDYVKQNTEQAIKLFERTARAKDTDAMMMLSNIYRLQNQPEKSLEWLKKAAELGNKEAKQRLSSQP

SEQ ID NO: 3829 - protein, 152 aa, H. influenzae strain 86-028NP
MIKYEVTLESSHFLRKLMKIGALAKALGCTVETIRYYEQQGLIPPPKRTLGNFRQYNEEHLQRLSFICNCRNLDISLSEIKSLLNLENASKQQAEEINRVLDKHIKEVATRIHELAHLRMKLIELREKTVSNDEDPMKLLLQHSGVKFVRLK

SEQ ID NO: 3830 - protein, 227 aa, H. influenzae strain 86-028NP
MELKKIAVGLTALLGMSVANAHNVWLEPASSQDEYVVKFGHEQTETYPESKLKSIQALNAQGKLTAVDYQFRNGEAYLMPKSDLVFVHFDNGVWSKLPSGKYVEKTKREEPTAEFSTNPVKFGKAILKWDAESFKSHQQAYELIPQEKAQANKPLSILVLHNGKPVQGIKVGVSEDAPFNLTNEKGIAQFTPTKGFNKVWAEFEEKVTNNADYDRRTVEYMLTFDAQ

SEQ ID NO: 3831 - protein, 162 aa, H. influenzae strain 86-028NP
MKKFAFLTALFAACYLPNAYAHALYVFAQYDGQTLSGKSYYSDMTPAAETYLEVFRSGVSDPVLTGKTDRQGAFKLSIADVPHTTLKVVVEGDEGHRASVVAAAHTSAENQSSADLMLLREDIAHLKDKIYLHDILGGIGYIVGIAGLIALRNARKIKQGRI

SEQ ID NO: 3832 - protein, 206 aa, H. influenzae strain 86-028NP
MHLSEGVLHTPILLAGAVLAVAGIAVGVRRLESERLPLTALFAAAFFVAGTIHVPVGIGSVHLILNGMAGLFLGWAVFPAFLIALLLQVIFFSFGGFAVLGVNLCVMAIPAVIAYYLFRSRLQPQMALKDRLLVGIGAGVIGVGGAGVLASFVLMLDGGKSYLNLVWLLLVSHIPVFVLDSIISVGVITLLGKMYPEVMNRTENFS

SEQ ID NO: 3833 - protein, 210 aa, H. influenzae strain 86-028NP
MKIHRLFQPHFRLIYLFIWGLIISGLSDLTWLISLNVLAVSLFFISLQLSQKSFLPYLKRWFALVIFIALMWAALSWQIGENGIELNFQGIELAEKLSLRTHLLLISLWLFLWNINDAVLVQAIGKLPLPEKLIQLFVLTVRYIALLGELRQKMDIAMRARGFRPGLNRRTLYVTAQSVALLLIHALLKAETAQMALKCRGFQFGKKREK

SEQ ID NO: 3834 - protein, 208 aa, H. influenzae strain 86-028NP
MLAVNNLCIERNGRAIIQDLSFTLEGQKRLFVQGEIGSGKTTLLLALLGFVPVTKGEIKLFGKVCREEKDFAPFRGTIGICFQNADDQLFGPTVLDDVAFGPLNQNMPREQAYHIAEQQLERLGITGLKDRMVHTLSGGEKNFTALAGVLAMQPKILLLDEPTNGLDRKNTEKLTALLRELSLPMLISSHHHGFINELATEIIRFTNK

SEQ ID NO: 3835 - protein, 396 aa, H. influenzae strain 86-028NP
MFEHIKAAPADPILGLGEAFKSETRENKINLGIGVYKDAQGTTPIMRAVKEAEKRLFDKEKTKNYLTIDGIADYNEQTKALLFGKDSEVIKSNRARTVQSLGGTGALRIAAEFIKRQTKAQNVWISTPTWPNHNAIFNAVGMTIREYRYYDAERKALDWDHLLEDLSQASEGDVVLLHGCCHNPTGIDPTPEQWQELAALSAKNGWLPLFDFAYQGLANGLDEDAYGLRAFAANHKELLVASSFSKNFGLYNERVGAFTLVAENAEIASTALTQVKSIIRTLYSNPASHGGATVATVLNDTQLRQEWENELTEMRERIKKMRHLFVQLLKEYGAEQDFSFIIEQNGMFSFSGLTGEQVDRLKEEFAIYAVRSGRINVAGITEDNIRYLCESIVKVL

SEQ ID NO: 3836 - protein, 362 aa, H. influenzae strain 86-028NP
MQNSTLYPTVYVLGNGQLGRMLGYAGAPLDIYVEPLAFNAPVFDLPENAIITAEIERWEKTPLTELLGNHKNFVNQHVFGLLADRFAQKSLLDELNLSTSPWCLLKDKTQWNDVFQTVGEKVVVKRRTGGYDGRGQWIISDENKADITDDLFGEVIAEKFIPFDYEVSIVGARFKNGEKRFYPVTHNLQQNGILRYSVIDNAFPQQSAQQKQAETMLGKIMDKLGYVGVMAMECFVVGDKLLINELAPRVHNSGHWTQLGCAISQFELHLRTLLDLPTPDLQIFAPSVMVNLIGTNHNPKWLNIPFAQLHWYGKEVRAGRKVGHINLSHPNKAVIIQQLEKLRIELPEDYQSGLNWAIEKLK

SEQ ID NO: 3837 - protein, 164 aa, H. influenzae strain 86-028NP; identical to SEQ ID NO: 622

SEQ ID NO: 3838 - protein, 82 aa, H. influenzae strain 86-028NP
MGRTEKLLDKLAQSKSTFNWNELVSLLAQQGYEKREMAGSRVRFYNRTLEHTILLHKPHPENYIKGGALKSVKESLKQVGIL

SEQ ID NO: 3839 - protein, 114 aa, H. influenzae strain 86-028NP
MKLLNYKGYVGTIEADLENNILFGKLAYIRDLVTYEAESLSELEKEFRQSVDLYLQDCLELGKEPNKPFKGVFNVRIGEELHREATIIAGDRSLNAFVTEAIQEKIFREKPSLR

SEQ ID NO: 3840 - protein, 869 aa, H. influenzae strain 86-028NP
MLAKAKYRKDYKQPDFTVTDIYLDFQLDPKHTVVTASTKFQRLNDEATSLRLDGHSFQFSSIKFNGEPFSAYQQDGESLTLDLKGKSAEEFELEIVTFLVPAENTSLQGLYQSGEGICTQCEAEGFRQITYMLDRPDVLACYTTKITADKSKYPFLLSNGNRIASGELEDGRHWVEWNDPFPKPSYLFALVAGDFDLLQDKFITKSGREVALELYVDRGNLNRATWAMESLKKAMKWDEDRFNLEYDLDIYMIVAVDFFNMGAMENKGLNIFNSKFVLANPQTATDEDYLAIESVIAHEYFHNWTGNRVTCRDWFQLSLKEGLTVFRDQEFSSDTGSRAVNRINNVKFLRTVQFAEDASPMSHPIRPEKVIEMNNFYTVTVYEKGAEVIRMLHTLLGEQGFQKGMQLYIAENDGKAATCEDFVSAMERANNLDLNQFRRWYSQSGTPELLISDAYDEKTHTYRLTVSQSTPPTADQMEKVNLHIPLKIALYDANGTKQMLQHNGELLSDVLNVTEKDQVFEFHGIYGRPIPALLCDFSAPVKLDYDYKTEQLLGLLKFADNQFIRWDAAQMLFAQELRRNVVRFQQGEALEISPEILTALSYVLNNYEKDIELATLILTLPKEMEFAEGFKTIDPDGISVARAFMQAQIAESLKDDFLRVYTHIRLDDYQVTQQDIALRAMRNLCLTYLAYTNLGNNLVQKHYNNANNMTDTLAALSVATKAALPCRDALLADFEQKWQQDGLVMDKWFALQATRPDENVLEIIQLLMDHPSFNFNNPNRLRSLVGSFANHNLKAFHNVSGSGYRFLTDVLIRLNESNPQVAARLIEPLIRFSRFDAQRQTLMKRALERLSVVENLSKDLFEKIEKALQ

SEQ ID NO: 3841 - protein, 204 aa, H. influenzae strain 86-028NP
MFTGIVQGTAPIHSIKETANFRTQVVKLLPEMRKDLEIGASIANNGVCLTVTEINGDLVSFDLMQETLKITNLGTIKVGDYVNIERAMQMGTEIGGHLLSGHIYCTAKISDIIASENNRQIWFELPNADVMKYILTKGFVAVDGISLTIGEVKGTQFCVNLIPETLQRTLMGQRKVGDIVNIEIDPQTQAIVDTVENYLQSKNF

SEQ ID NO: 3842 - protein, 464 aa, H. influenzae strain 86-028NP
MNFRLLSQYHADIKKLIKISLPILLAQIAQNSMGLADTIMAGRVSSTDMAAISIGASIWMPLMLFGQGLLLALPPTISYLNGSGQRHRIAHQVRQGIWLVLGVSIPLGLLIYFCEIPLQYMQMESKMSDLARDYLHAMLWGLPAYLMLINFRCLNDGIAKTKPAMVITFLGLLINIPLNYIFIYGKFGIPAFGAVGCGIATAIVNWAMCLMMIFYSYTNAQERSLKVFSQLIEMPNLKTLKKLLRLGLPIAIAICCEVALFALTSLMLSPLGATIVASHQITLNTSSFIFMFPMSIGMAATILVGQALGTGSPQNAKKIGYAALLLGLTVTIITALITIFFRYEIASIFVTDEIVIAMAANLLLFAALYQFSDTIQMVVGGILRGYKDTKMILYITLFSYWVIGVPLGYTLGRTDWLIPHIDAKGFWIAFVVSLTFAAFLLSLRMKKMQAMSDNAILQRLEKLK

SEQ ID NO: 3843 - protein, 238 aa, H. influenzae strain 86-028NP
MQLPALQSAKLIRRYKRFLADIELPTGDVMTIHCANTGAMTGCGEKGDTIWYSHSDSQTRKYPHSWELTQLANGQLCCINTHRSNQLVFEALQNKQIKELAMYDEIYPEVKYGEENSRIDFLLKGEGLPDCYVEVKSITLVKGNLGMFPDAVTTRGQKHVRELLAMKKQGHRAVVLFAGLHNGFDRFKIAEYIDPEYDRLLKEAMEQGVEAYAYAGQFEISNEIPTALSLTESVPYIK

SEQ ID NO: 3844 - protein, 395 aa, H. influenzae strain 86-028NP
MTNINTVLAELKRGTDEILSEADLIEKLKENRPLKVKLGADPTAPDIHLGHTVVLNKLRQFQQLGHEVYFLIGDFTGMVGDPSGKNATRPPLSREDVLRNAETYKEQIYKILDPQKTKIVFNSEWLSKLGTEGMIRLASNYTVARMLERDDFKKRFGNNQPIAIHEFIYPLLQGYDSVALDADVELGGTDQKFNLLVGRELQKSAGKKPQVAITLPLLVGLDGEKKMSKSLGNYIGVTEAPSDMFGKVMSISDELMWDWYNLLSFRPLSEIAQLKSEVEKGKNPRDVKILLAKELIARFHNEEAANAAEQEFINRFQKGAMPDEMPEFTFSGEIGLATLLKEAGLVPSTSEAIRSAQQGGVKINGEKVDNVKDNAPKGTNVYQVGKRKFARVTVE

SEQ ID NO: 3845 - protein, 315 aa, H. influenzae strain 86-028NP
MPDIKLFAGNATPELAKRISERLYISLGDATVARFSDGEIQVQINENVRGADVFIIQSTCAPTNDNLMELVVMVDALRRASAGRITAVIPYFGYARQDRRVRSARVPITAKVVADLLSIVGIDRVLTCDLHAEQIQGFFDVPVDNVFGSPVLIHDILKKSDLENPIVVSPDIGGVVRARAVAKLLNDTDMAIIDKRRPRANVAQVMHIIGDIADRDCILVDDMIDTGGTLCKAAEALKERGAKRVFAYATHAVFSGAAAKNLASDAIDEVVVTDTIPLSEEMKAIGKVRVLTLSSMLAEAIRRISNEESISAMFN

SEQ ID NO: 3846 - protein, 317 aa, H. influenzae strain 86-028NP
MNTLMKSHQFSTALCQNTTQSNGQPLRFPSPAKLNLFLYINGKLPNGYHELQTLFQFLDFGDWLDISIREQDNQIVLTPEIPNLKTENNLIYRAAKLLQEKANIQLGANIHLDKILPMGGGVGGGSSNAATALVSLNYLWQANLSIDELAKLGLTLGADVPIFVYGQAAFAEGVGEKITYCEPAEKWFVILKPDDSISTAVIFQDPNLPRNTPKKSLEQLLSEPYKNDCEKVVINHYSNVEKALNWLLQYAPARLTGTGACVFAEFDHEAEAQAVFRQKPEAFFGFVAKGLNVSPLHAMLKQLSSTHTHRQSKPEVL

SEQ ID NO: 3847 - protein, 209 aa, H. influenzae strain 86-028NP
MNNMKTFKFLTALFATAILTACTLDMERPTNVQYIDKTDAIWQQHLQKIQKIQSYQAKGQIGYISPTERFSSRFEWQYQNPKSYTLKLYSLISKSTLLIQMHQSGMTISDNNDNQQSAANAKLLLQEIIGMDVPLEHLAYWLKGQPAMNADYQVGTNHLLGAFTYHVDGSQWTADYLTYHSNNSMPENILLKNDSTKQTLKIRVDEWIY

SEQ ID NO: 3848 - protein, 416 aa, H. influenzae strain 86-028NP
MKIYLVGGAVRDQLLGLPVKDRDWIVVGADHATLLSLGYQQVGKDFPVFLNPKTKEEYALARTERKSSAGYTGFICDFSPTITLEQDLIRRDLTINAMAQSEDGEIIDPYGGKQDLENRILRHISPAFSEDPLRVLRVARFAARYHSLGFKIASETLALMTELALSGELQHLTAERVWLETEKALNEKNPEIYFETLHKTGALSVLFSEIDALHGVPNPVKHHPEVDSFIHTMLVLKQAVNLTENNPILNKSAVRFAAICHDLGKALTPQNILPHHYGHEQAGIKPTRSLCKRLKVPSYFQELAELTCEFHTHIHKAFELRAETVITLFNRFDVWRKPQRFQEFLQVCLADTRGRTGFETKDYPQIDYINQLLHSANEVDVQQVIADGFEKQAIKNELTKRRILAVKQTKTNYPTN

SEQ ID NO: 3849 - protein, 203 aa, H. influenzae strain 86-028NP
MKKIYKALISSLLLSTSINVAYAETQYVTENLSTFLRRGAGEQFKIAGSIQAGEAVNVLERQGKYTLIRDNKNREAWILNSDLSSTPSSKEENPKLKAQVQELTLKLSRLDGDWQQRTVEMQRRTKQAEQQSADLLEQNSQLKRELEMTKNKNRDLEAILDAGKREIAIQWFIYGGSVLGVGLLFGLLIPYVLPKRRRRDGWA

SEQ ID NO: 3850 - protein, 420 aa, H. influenzae strain 86-028NP
MEIISQYGSWLVWITAAFGFFMAFGIGANDVSNSMGTSVGSGTVTAKQAIIIALIFESAGAYLAGGEVTQTIKSGVIDPIQFVDTPDILALGMLSTLFASGAWLFIVTKMGWPVSGIHTIIGAIIGFACITIGPSSVDWSNIGSIVGSWFITPVISGILAYAIFASTQKLIFDTEQPLKNAQKYGPYYMGITVFVLCIVTMKKGLKHVGLNLSNSETLIISLAISLIGMFFFHFYFKSKIFTQSANKGTFGAVEKVFSILMLLTACAMAFAHGSNDVANAIGPLSAVVSIVNEGGKIVSGGALTWWILPLGALGIAVGLITMGQKVMATVGSGITDLTPSRGFAAQFATAMTVVVASGTGLPISTTQTLVGAILGIGFARGIAALNLTVIRNIISSWIVTLPAGAFFAIIIFYVLRTIFN

SEQ ID NO: 3851 - protein, 226 aa, H. influenzae strain 86-028NP
MAMNNILGLFAHSPLKPLQKHSEKVTECSDLLIPFFQTTFSKNWEQAEEKRLEISQCEREADSLKREIRLKLPRGLFLPIDRTDLLELVTQQDKLANYAKDIAGRMIGRQFGIPEEMQEEFLHYVKRSLDAIHQAHRVIEEMDKLLETGFKGRELKLVNDMIQELDSIEDDTDQMQIKLRKMLYTIESRYNPIDVMFLYKIIEWVGVLADQAQRVGSRIELMLARS

SEQ ID NO: 3852 - protein, 151 aa, H. influenzae strain 86-028NP
MKDCKMQSIGSGVSLLILRFFLAWEFFEAGLEKWNGQNWFAEIQDRFPFPFNLIPADINWHVAMGSELIFPFLLIFGVLTRFSALSLTILISVAWYSIHADSGYNVCDNGYKLPLIYVVTLLILITQGAGKLSLDTLIKKVYPTKSWLKFL

SEQ ID NO: 3853 - protein, 95 aa, H. influenzae strain 86-028NP
MKKLATLTALASALTMAVATAVQAESKSSNTDNTATPCVGDKCVKTKAAEGKCGEGKCGADKAKSAEGKCGEGKCGASKPKAAEGKCGEGKCGSK

SEQ ID NO: 3854 - protein, 317 aa, H. influenzae strain 86-028NP
MPAFIKKELIMKLQGAGLGYRRNLAEDFLQLPSNNAIQFIEVAPENWSKMGGMARYQFDQAAERFPLAVHGLSLSLGGQAPLDRELLRNTKALINQYNSSFFSEHLSYCECEGHLYDLLPMPFTEEAVKHVAQRIRDVQDFLGLQISLENTSYYLHSPTSTMNEVEFLNAIAQEADCGIHLDVNNIYVNGVNHGLLDPYIFLDQVDVKRVNYIHIAGHDEEHSAAQVVENSANESFNKVKGAYRHLPELLIDTHGEAVKGTVWDLLEYAYQRLPTIPPTLLERDFNFPPFAELYAEVEHIAQLQQKYAHTEVMSYAA

SEQ ID NO: 3855 - protein, 238 aa, H. influenzae strain 86-028NP
MQPKSSLKETQQALANAIRLGNADPLNGYAESRLAVYTRLVRNNAFGFIDRCFVEAPLHIELEYWKNAKENFVQNGNAHSPYFQDIAGEFLLFCQEKEIFDTNILALMDFENTQLLAEVSLAKVPEKFEWNRHSVMQLSGAAYLKSYEVDFLSSDFKQFDDTPIQVIIWRDSDFRIQQQILSELDYWLLSYLQEQPNSLENVLSALNTMVEDSTSIIPLLEQVWMKWVTSEVIYPEQR

SEQ ID NO: 3856 - protein, 55 aa, H. influenzae strain 86-028NP
MMPWIETDAMQQRVLFLKAWLSQRYTKTELCQQFNISRPTADKWIKRHQQLGFEG

SEQ ID NO: 3857 - protein, 38 aa, H. influenzae strain 86-028NP
MHCSLKAALQPQNSFEAQQILFNQFLREYNEERSHEGV

SEQ ID NO: 3858 - protein, 54 aa, H. influenzae strain 86-028NP
LHHKITNTHKKTTCIKPHTESAKKHAMIYVEDLQVENMSKSAKGTAEKHGKNVK

SEQ ID NO: 3859 - protein, 650 aa, H. influenzae strain 86-028NP
MTKENLQNAPQNTTVSLVESNNNQTSPQMLQQSPKPSLLRLEQHIEKKDYEFACRELMVILEKMDANFGGVHDIEFDAPAQLAYLPEKLLIHFATRLANAITTLFSDPELAISEEGALKMISLQRWLTLIFASSPYVNADHILNKYNINPDSEGGFHLATDNSSIAKFCIFYLPESNINMSLDALWAGNQQLCASLCFALQSSRFIGTASAFHKRAVVLQWFPKKLAEIADLNELPANILHDVYMHCSYDLAKNKHDVKRPLNELVRKHILTQGWQDRYLYTLGKKDGKPVMMVLLEHFNSGHSIYRTHSTSMIAAREKFYLVGLGSESVDEIGREVFDEFFEISSNNIMERLFFIRKQCETFQPAVFYMPSIGMDITTIFVSNTRLAPIQAVALGHPATTHSEFIDYVIVEDDYVGSEDCFSETLLRLPKDALPYVPSALAPQKVDYVLRENPEVVNIGIAATTMKLNPEFLVTLQEIRDKAKVKIHFHFALGQSTGLTHPYVKWFIESYLGDDATAHPHAPYHDYLAILRDCDMLLNPFPFGNTNGIIDMVTLGLVGVCKTGDEVHEHIDEGLFKRLGLPEWLIADTRETYIECALRLAENHQERLELRRYIIENNGLQKLFTGDPRPLGKILLKKTNEWKRKHLSKK

SEQ ID NO: 3860 - protein, 545 aa, H. influenzae strain 86-028NP
MKNIKSRLKLSAISVLLGLASSSLYAEEAFLVKGFQLSGALETLSEDAQLSVAKSLSKYQGTQTLTNLKTAQLELQAVLDKIEPNKFDVILPQQTITDGNIMFELVSKSAAESQVFYKASQGYSEENIARSLPSLKQGKVYEDGRQWFDLREFNMAKENPLKVTRVHYELNPKNKTSNLIIAGFSPFGKTRSFISYDNFGAREFNYQRVSLGFVNANLTGHDDVLNLNALTNVKAPSKSYAVGVGYTYPFYSKHQSLSLYTSMSYADSNDIDGLPSAINRKLSKGQSISANLKWSYYLPTFNLGMEDQFKINLGYNYRHINQTSELNTLGATKKKFAVSGVSAGIDGHIQFTPKTIFNIDLTHHYYASKLPGSFGMERIGETFNRSYHISTASLGLSQEFAQGWHFSSQLSGQSTLQDISSIDLFSVTGTYGVRGFKYGGASGERGLVWRNELSMPKYTRFQISPYAFYDAGQFRYNSENAKIYGEDMHTVSSAGLGIKTSPTQNLSLDAFVARRFANANSDNLNGNKKRTSSPTTFWGRLTFSF

SEQ ID NO: 3861 - protein, 1542 aa, H. influenzae strain 86-028NP; identical to SEQ ID NO: 670

SEQ ID NO: 3862 - protein, 348 aa, H. influenzae strain 86-028NP
MLQEIELKLAISPQIGIELPQYLAKFTILEHQNLFLGNTYYDYPDHFLAKQKMGLRIRQEEQELTLTLKTNGKVVGGLHSRPEYNLLLTEKETPTNAQLRELYPFEQLPRSSLQPIFSTDFNRTFWLVEFQQSKIEVAFDQGKIIAGESEQPICEIEFELKSGNVQDLFDFVETLPFERDIYFNSGSKAKRGYLLGSKQFLTDWLNKWRDFLKEEREESAVDFCVKFNSVLKMEQKLLEETLSFSPALFSQDFMKTVERVGVFFNLYHYYDENGKILEAVATEKQKETLLLALLESNQKIFAEIRDLIRFHSETKDNEKTIEKLTALLKSRVYFKRMIKLMELSYDLG

SEQ ID NO: 3863 - protein, 458 aa, H. influenzae strain 86-028NP
MAKAPKTAYVCNDCGAEFSRWQGQCSACKAWNTITEVRLISTAKSKNDRFSGYAGETQAKIQTLSEISLQETPRFSSGFNELDRVLGGGIVPGSAILIGGHPGAGKSTLLLQVMCGLAKNMTALYVTGEESLQQVAMRASRLGLPNDQLKMLSETSVEQICNLSDQLKPQIIVVDSIQVMHLADIQSSPGSVAQVRECASFLTRYAKTRQVAIIMVGHVTKDGTLAGPKVLEHAIDCSLLLEGEADSRYRTLRSHKNRFGAVNELGVFGMTEQGLREVKNPSAIFLSRGDEITSGSSVMVLWEGTRPLLVEIQALVDHSMLANPRRVAVGLEQNRLSLLLAVLHRHGGLQMADQDVFVNVVGGVKVSETSADLALLLALISSFRNRPLPQDLVIFGEVGLAGEIRPVPSGQERISEAAKHGFKRAIVPFGNKPKSAVENMQVFTVKKLTDALAVLDNL

SEQ ID NO: 3864 - protein, 166 aa, H. influenzae strain 86-028NP
MCKEIKKMEKKRNKALDAIDIKILNELQRNGKISNIDLSRKVGLSPTPCLERVKRLEKQGVIMGYRALLNPELLDAPLLVIVEITLVRGKPDVFEEFNAAIQELDEIQECHLVSGDFDYLLKTRVADMAEYRKLLGTTLLRLPGVNDTRTYVVMEEVKQTNFLVLK

SEQ ID NO: 3865 - protein, 918 aa, H. influenzae strain 86-028NP
MIKQITERFTPRQYLAEFLLGLTALFGFYLIVAWSSYTPLDNSWATASAYGNTINKVGTFGAWIIDLFFVFFGYVAHIIPFTAFLVPIYLLKTKAVKQLSCTRIILRSFGFTMLIIGLCVVSMLLLSSNTFYLSGGVLGGSLVVNWFYPVLGKFGSILIGFVLALIGFIFCSGASLIRLIVAFYHWLTMKNEQSENAEQEKSTEELEQIVIVKSDRSETENLDQNHLNVEQNSEIETQKSSLEAEESSVEQPSHLINIHGLNPEVSIKSEYELANEDSEKPQFSFGFDSESLPSVNLSSDSDEQRVSKNDFVVVWNKPVKTVVQEDLAINQSADDFTQVSLLTNDEMPTVSLKSTSDTEMADNHFAAQVDEKVDLEKDEVKFSVSLQNNVGVIELDKNQEPNYKGYSGSLIHPAFQQQTTKREKPSTPLPSLDLLLKYPPNEQRITPDEIMETSQRIEQQLRNFNVKASVKDVLVGPVVTRYELELQPGVKASKVTSIDTDLARALMFRSIRVAEVIPGKPYIGIETPNLHRQMVPLRDVLDSNEFRDSKATLPIALGKDISGKPVIVDLAKMPHLLVAGSTGSGKSVGVNTMILSLLYRVQPEDVKFIMIDPKVVELSVYNDIPHLLTPVVTDMKKAANALRWCVDEMERRYQLLSALRVRNIEGFNEKIDEYEAMGMPVPNPIWRPSDTMDAMPPALKKLSYIVVIVDEFADLMMVAGKQIEELIARLAQKARAIGIHLILATQRPSVDVITGLIKANIPSRIAFTVASKIDSRTILDQGGAEALLGRGDMLYSGQGSSDLIRVHGAYMSDDEVINIADDWRARGKPDYIDGILESADDEESTEKGISSGGELDPLFDEVMDFVINTGTTSVSSIQRKFSVGFNRAARIMDQMEEQGIVSPMQNGKREILSHRPEY

SEQ ID NO: 3866 - protein, 205 aa, H. influenzae strain 86-028NP
MKKTTLKFAALTLLGLSNLALADAASELQMRLAKVDVLSAEFVQTVTSGSGKNVQQGSGKLQIKRPNLFRMETKTPQETQIISDGKTLWFYDPFVQQVTAQWVKNAVNNTPFVLLTSNDNSHWHQYTVTQQSDTFVLKPTLSTSNIKQFDIRVDANGILRNFSTTEKDGQTNLYVLRNITNQTLSDSLFQFKPEKGVEVDDQRKK

SEQ ID NO: 3867 - protein, 446 aa, H. influenzae strain 86-028NP
MSNLNFDFAENDFRPLAAKMRPTNLEQYFGQSHLIGEGKPLRKAIQAGHIHSMILWGPPGTGKTTLAEIIAQRINAEVERISAVTSGIKEIREAIDRAKQNRLADRKTILFVDEVHRFNKSQQDAFLPHIEDGTVIFIGATTENPSFELNNALLSRARVYVLKSLTTAEIEQVLQQAVEDPERGLGKERLILEENLLQVLAEYVNGDARLALNCLELMVDMADEMENGKKIDRTLLKEVLGERQARFDKQGDRFYDLISALHKSVRGSAPDAALYWYARILTAGGDPLYVARRLLAIASEDVGNADPRAMQVALAAWDCFTRVGAYEGERAIAQAIIYLAVAPKSNAVYTAFNTAKQQAKDLPDYDVPPHLRNAPTNLMKELGYGAEYRYAHDEPNAYAAGENYFPPELKDTQYYFPTNRGMEIQIKEKLERLREQDKSTVKKRYK

SEQ ID NO: 3868 - protein, 380 aa, H. influenzae strain 86-028NP
MIFSKNKYPPLHEFTALMNRVDNFLNHDAENRIAYYKKRSGIDLEKDVYEAICYCAQNTPFEDTISLVSGKHFPDIVASQYYGIEVKSTQGDKWTSIGSSILESTRIPNIEKIFLTFGKLGGNIKFLSKPYESCLCDIAVTHYPRYKIDMLLEKGESIFEKMETTYDSLRELDNPITPVAKYYKSLLIEGESLWWTSNNVLDDIAPPKVRHWKVIEKYERDMLIAQAYAFFPETILGNPRNKYDKFALWLVTKHGVINTSLRDEFSAGGQQKITDTCGETHLCSAVLKRVENNILAIKKFILETPENILTELWGNYIKDDRITQWANLVLSYCKPSNHNEMKLILTKIVNEKTIFNDKDDVNKLEEMAKIYITNQKINSL

SEQ ID NO: 3869 - protein, 407 aa, H. influenzae strain 86-028NP
MKLISLFSGCGGMDIGFEGSFSCLKKSINEELHPEWISSTENEWVTVSPTSFETIFANDIKPDAKAAWVSYFLDQKANANEIYHLESIVDLVKKERETHNIFPKDIDILTGGFPCQDFSVAGKRLGFDSHKNHHGKISNIDEPSIENRGQLYMWMREVISITQPKLFIAENVKGLTNLKDVKEIIEHDFGQASDEGYLVVPAQVLNAQFYGVPQSRERVIFFGFKKNALNKKALEELQKENIAEDYNPYPPPTHGKENLKAVVTCTDAFINLQEPNFSKDPSQQKYSKAKYMGNHCQGQVEIKLNSVGPTIRSEHHGNIEYRRLSIEHGGKYINELSKGMLERRLTIRECARLQTFPDRYQFILPKTAENVSVSASNAYKIIGNAVPCVLAYNIAKNIEKKWNLYFK

SEQ ID NO: 3870 - protein, 432 aa, H. influenzae strain 86-028NP
MEKITLAPISAVEGTINLPGSKSLSNRALLLAALAKGTTKVTNLLDSDDIRHMLNALKALGVRYQLSDDKTICEVEGLGGTFNIQDNLSLFLGNAGTAMRPLTAALCLKGKTESEIILTGEPRMKERPILHLVDALRQAGADIRYLENEGYPPLAIRNKGIKGGKVKIDGSISSQFLTALLMSAPLAENDTEIEIIGELVSKPYIDITLAMMRDFGVKVENHHYQKFQVKGNQSYISPNKYLVEGDASSASYFLAAGAIKGKVKVTGIGKNSIQGDRLFADVLEKMGAKITWGEDFIQAEHAELNGIDMDMNHIPDAAMTIATTALFSNGETVIRNIYNWRVKETDRLTAMATELRKVGAEVEEGEDFIHIQPLPLNQFKHANIETYNDHRIAMCFSLIALSNTPVTILDPKCTAKTFPTFFSEFEKICLRD

SEQ ID NO: 3871 - protein, 278 aa, H. influenzae strain 86-028NP
MIEKKILLTDCPDDKGLIAKITNICYKHQLNILHNNEFVDFETKHFFMRTELEGIFNEATLLEDLKYSLPEETNCRLIGTQRKRIVILVTKEAHCLGDILMKNYYGALDVEIAAVIGNHDNLRELVERFNIPFHLVSHENLTRVEHDKLLAEKIDEYTPDYIVLAKYMRVLNPEFVARYPNRVINIHHSFLPAFIGAKPYQQAYERGVKIIGATAHFINNELDQGPIIMQNVINVDHTYNAEAMMRAGRDVEKTVLSRALDLALHDRIFVYKNKTVVL

SEQ ID NO: 3872 - protein, 134 aa, H. influenzae strain 86-028NP
MNELVRGLTNLRSLRAAVRELTLEQAENALEKLQTAIEEKRANEAELIKAETERKERLAKYKELMEKEGITPEELHEIFGTKTVSIRAKRAPRPAKYAFIDENGEHKTWTGQGRTPRPIQNALNKGKSLSDFEI

SEQ ID NO: 3873 - protein, 519 aa, H. influenzae strain 86-028NP
MLSVLSINYRYYLMELIDFSSSVWSIVPALLAIILAIATRRVLVSLSAGIIIGSLMLSDWQIGSAFNYLVKNVVSLVYADGEINSNMNIVLFLLLLGVLTALLTVSGSNRAFAEWAQSRIKDRRGAKLLAASLVFVTFIDDYFHSLAVGAIARPVTDRFKVSRAKLAYILDSTAAPMCVMMPVSSWGAYIITLIGGLLATYSITEYTPIGAFVAMSSMNFYAIFSIIMVFFVAYFSFDIASMVRHEKLALENTEDQLEEETGKKGQVRNLILPILVLIIATVSMMIYTGAEALAADGKVFSVLGAFENTVVGTSLVVGGFCSIIISTLLIILDRQVSVPEYARSWIVGIKSMSGAIAILFFAWTINKIVGDMQTGKYLSSLVSGNIPMQFLPVILFVLGAAMAFSTGTSWGTFGIMLPIAAAMAANAAPELLLPCLSAVMAGAVCGDHCSPVSDTTILSSTGAKCNHIDHVTTQLPYAATVATATSIGYIVVGFTYSGLAGFAATAVSLIVIVFAVKKR

SEQ ID NO: 3874 - protein, 49 aa, H. influenzae strain 86-028NP
LSHFFIFIDVKIYKKLNFHLSLVFYIFLIDFFVVLVARQIFFTLYDVEY

SEQ ID NO: 3875 - protein, 573 aa, H. influenzae strain 86-028NP
MKKLSGAEMVVQSLRDEGVEYVFGYPGGAVLDIYDAIHTLGGIEHILVRHEQAAVHMADGYARSTGKVGCVLVTSGPGATNAITGILTAYTDSVPMVIISGQVMSNLIGSDAFQECDMLGISRPVVKHSFIVKKAEDIPSTLKKAFYIASTGRPGPVVVDIPKDTVNPNFKYPYEYPESVELRSYNPTVNGHKGQIKKALKALLVAKKPILFVGGGAITAECSKQLIQFAQRLNLPVTSSLMGLGAYPSTDKQFLGMLGMHGTLEANTAMHESDLILGIGVRFDDRTTNNLEKYCPNAKVIHIDIDPTSISKNVPVAIPIVGNAKNVLEEFLGLLNEEGLKSQTDLESWWQEINQWKAKKCLEFDRTSGVIKPQQVVEAVYRLTKGQAYVASDVGQHQMFAALHYPFDEPRHWINSGGAGTMGFGFPAALGVKLAHPEGTVVCVTGDGSIQMNIQELSTATQYGIPVVIICLNNHFLGMVKQWQDLIYSGRHSQTYMNSLPDFAKLAESYGHVGIKIATPDELESKLQEAFSIKNKLVFVDINVDESEHVYPMQIRGGAMNEMILSKPQEETN

SEQ ID NO: 3876 - protein, 163 aa, H. influenzae strain 86-028NP
MRRILSVLLENESGALSRVVGLFSQRAFNIESLTVAPTDDPTLSRMTIEAVGDAQALEQIEKQLHKLVDVFKVVNLSEQEHIEREIVLAKVRAVGSSRDEIKRLADIFRGQIVDVTPKSYTIQLSGTNDKVDAFISALKEETTLLEIVRSGLISVSRGEKNIL

SEQ ID NO: 3877 - protein, 577 aa, H. influenzae strain 86-028NP
VNIQSILSDKIKQAMVIAGADQSCDALVRQSGKPQFGDYQANGIMAAAKKLGLNPREFAQKVLDNLQLSDIAEKLEIAGPGFINIFLNPTWLTTEISAALSHKNLGIQATNKQTVVIDYSSPNVAKEMHVGHLRSTIIGDAVARTLEFLGHNVIRANHVGDWGTQFGMLIAYLEKMQNEHASEMELQDLEAFYREAKKHYDEDEIFAEKARNYVVKLQSGDEYCRTMWKRLVDITMQQNQHNYNRLNVTLTEKDVMGESLYNPMLPSIVEDLKKQGLAVENDGALVVYLDEFKNKDGDPMGVIVQKKDGGFLYTTTDIAAAKYRYETLKANRALVFSDTRQSQHMQQAWLITRKAGYVPDSFSLEHKNFGMMLGKDGKPFKTRTGGTVKLADLLNEAIERATVLINEKNTNLSNDEKQAVIEAIGIGSVKYADLSKNRTTDYVFDWDNMLSFEGNTAPYMQYAYTRIRSIFNKTDINSTALLAAPLTIKDDKERTLAIKLLQFEEAVQTVGKEGTPHVLCAYLYELAGIFSSFYEHCPILNAENESIKLSRLKLALLTEKTLKQGLTLLGIKTVEKM

SEQ ID NO: 3878 - protein, 189 aa, H. influenzae strain 86-028NP
MTNLQENLTALSADLATFERKIQHLAKEMTIDLSHYEIDHLALRVNSEQTAKNWLILLLKCGRILSDNIVNGRKIYLIELEKPVKFANQFVDIIELPLPKNKKYPIEGWEHIEIVVPFLPNESINEWIDRVNMYFLWNKLTQLTIKVSEPKVDGERLPNPSIAVSFTDKTVNHTCIKVHPYSIKKILEV

SEQ ID NO: 3879 - protein, 73 aa, H. influenzae strain 86-028NP
MKMLKGQIVFSQMEGENLKLTIRKNDCSGNQQKGEEVIIVHKYDSTLAIGACVTVSNNSQVKNISSFSPRNPF

SEQ ID NO: 3880 - protein, 154 aa, H. influenzae strain 86-028NP
MKKKTLALAILTIFSVAGCTNTDIFSGDVYSASQAKEARSITYGTIVSVRPVKIQADNQGVIGTLGGGALGGIAGSAIGGGRGQVIAAVVGAIGGAVAGSKIEEKVSQVNGAELVIKKDDGQEIVVVQKADSSFVAGRRVRIVGGGSNLNVSVL

SEQ ID NO: 3881 - protein, 323 aa, H. influenzae strain 86-028NP
MENPPLVSVIVCAYNAEQYIDESISSIINQSYKNLEIIVINDGSTDLTLSHLEEISKLDKRIKIISNKYNLGFINSLNIGLGCFSGKYFARMDADDIAKPSWIEKIVTYLEKNDHITAMGSYLEIIVEKECGIIGSKYKTGDIWKNPLLHNDICEAMLFYNPIHNNTMIMRANVYREHKLIFNKDYPYAEDYKFWSEVSRLGCLANYPEALVKYRLHGNQTSSVYNHKQNEVAKKIKGENITYYLNKIGIDIKVINSVSLLEIYHVDKSNKVLKSILYDMYMSLDKYTITSLLHFIKYHLKLFDLKQNFKIIKKFIRKINVMF

SEQ ID NO: 3882 - protein, 563 aa, H. influenzae strain 86-028NP
VRLKFQLFLMKGNTMKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRTTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 3883 - protein, 360 aa, H. influenzae strain 86-028NP
MNVKPATAKISSHALKQNLEIIKQKAPNSKIIAVVKANAYGHGVVFVASTLEQNVDCFGVARLEEALALRSNGITKPILLLEGFFNEQDLPILAVNNIETVVHNHEQLEALKRSNLPSPIKVWLKIDTGMHRLGVALDEVDYFYQELKKLPQIQPHLGFVSHFSRADELESDYTQLQINRFLSATKDKQGERTIAASGGILFWPKSHLECIRPGIIMYGISPTDTIGKEFGLTPVMNLTSSLIAVRHHKQGDPVGYGGIWTSPRDTKIGVVAMGYGDGYPRDVPEGTPVYLNGRLVPIVGRVSMDMLTVDLGADSQDLVGDEVILWGKELPIETVAKFTGILSYELITKLTPRVITEYVD

SEQ ID NO: 3884 - protein, 504 aa, H. influenzae strain 86-028NP
VDFSTVFYFLFSPHFSLKSNRYLRYHRRHSSIEISPMASQPQIKSSDKKTAQVSIPPHSIEAEQAVLGGIMLSNQHWDGIAERVIADDFYTFQHRLIFTEMEHLMRNQSPIDLITLDQALRSHGVSDEVGGFAYLAELSNNTPNAINILAYADIVREKAILRELISVGNRIAENSYSPKGQDIKLILDEAEREVFAIAEKRTTSSEGPQNVINVLESTIEKIDILSKLENHSGVTGVTTGFTDLDKKTAGLQPSDLIIVAARPSMGKTTFAMNLCENAAMASEKPVLVFSLEMPAEQIMMRMIASLARVDQTKIRTGQNLDEIEWNKIASVVGMFKQKNNLFIDDSSGLTPTDVRSRARRVYRENGGLSMIMVDYLQLMRAPAFSDNRTLEIAEISRSLKALAKELQVPVVALSQLNRTLEQRADKRPVNSDLRESGSIEQDADLIMFIYRDEVYNDNSEDKGVAEIIIGKQRNGPIGRVRLKFNGQFSRFDNLAEQREYRDDY

SEQ ID NO: 3885 - protein, 478 aa, H. influenzae strain 86-028NP
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLTSTGRTPLLMSRISSGLPIFALSRNQETLNLCALYRGVTPIYHGEESRTEAGAKAALQSLKEKGYLSTGDLVLVTQGGQGATQTNVCRTLIVE

SEQ ID NO: 3886 - protein, 419 aa, H. influenzae strain 86-028NP
MGGRMAVLVKPLSITEINNAKPKEKDYSLSDGQGLFLLVKMNGSKIWRFQYYKPISKKRTLISLGVYPEISLKDAREIRDLYRSLLAKNIDPQDYRLQQEQKAIQERQFTLSEMGKEWLYLKKNEVDTGRLKEVTFIDIGKRLERHLFKVLGHYSISEISAPLAIEKLKPLERAGKLDTLHRIIGYLNQIMIYSVNRGVINYNATADIGRVFIRPIAENNPTIRPEQLPKLFEDLQNSTLEIETRCALELLLLTAGRAGAITQLEWENVDFENSLLNIPKEKMKGRQGKVQDFILPLSKQAVTILRLLQKLNRCNSKFVFPSKKNPRQPISKETPNKALGRIGYRNILTAHGLRSVFSTAMNEAEFNSEIIEVCLAHFEYSSVRGTYNKAKYMPQRIEYMQWWGNFVEEASDGKALMGC

SEQ ID NO: 3887 - protein, 89 aa, H. influenzae strain 86-028NP
MSENNGWINCANELPEPFSTDLEYRNATNKHLIYFTEDGDHWAVGLGWYLYDDKSDCEGCLIPYWESDENPGEEVEVIYWQPLPQPPEE

SEQ ID NO: 3888 - protein, 56 aa, H. influenzae strain 86-028NP
MSNEITQKVRITIEVEMDDYQRDQLKISKNTQVLGGNIVLLDWEGGVFDEVDGYCI

SEQ ID NO: 3889 - protein, 177 aa, H. influenzae strain 86-028NP
MFGAVVRDENEIGEDMKVLDEHILEYIWDETLDRIAQHTLVTYIGGSVGTYSDDHAEKRAEDFAILSVRHLIEGSGLSESQFRRRVKKLMAQGVLLQRIGPNSFVINSDVVKDAAVHAARCWRAIGVPYGMDDTGRACKTLPINALPRSIFELKTNCYRILRSEYPSYKGKGVGNEQ

SEQ ID NO: 3890 - protein, 138 aa, H. influenzae strain 86-028NP
MDIINLIKQQTPEERQTLFNEFIKLLNQKREYVDIPERIVCSACQVFVDERDGTNEDGGEIIHEVYGLRHYDPFMRKQIKELEKQYKYALLDWEQGFLTNKGRFVGRKEAMEIAKAQNQVIRLSGSPNSDILFSEDLY

SEQ ID NO: 3891 - protein, 225 aa, H. influenzae strain 86-028NP
VSAFCFRRKKMKEFNLKAALNGEPVMLRNGGKAVVKYNLLNEVEKLEVRDTVYPLIGYRFDGIYINTTSWNLTGKSVHWATMEYDIIGMWEDPKLTSEQVLEKACNEDLLVLCDGNPDLPLKVIAKTKNGEFVMQPEDGIIQPWLANLTMEWFFVKKLDPKFDTSTLPKPFKPHIGDEFFYLSDGVIRYFSFYADCAANLMINGQCFRTKEDAQKWLDFMKSMME

SEQ ID NO: 3892 - protein, 387 aa, H. influenzae strain 86-028NP
MFTYGSICSGIEAVSVAWKGLSKPLWFSEIEPFPCAVLAYHYPNIPNLGDMTTLPEKILNREIPAPDVLVGGTPCQAFSVAGLRNSLDDERGNLTLTLIHILEAIDYVRYQDGKQPCVLLWENVPGVLSTKDNAFGHLLAGLVQEREPLQPTGAKWSNAGYVHSSRTIAWRILDAQYFGLAQRRKRVFLVASARERSVAQILFERKSLQGYSQSCGKTQQGFTCYAEGSFGTYRQSVLGGLVKASGGALGGGSETIVVHGTQDPIISTSTAHCLGRNNGQENVLFDISDRRDVVRIQKDGTTPTLTARMGTGGNNIPCMSINQNIRKLTPSECEKLQGFPPGYTQISYRNKPAEDCPDSPRYKAIGNSMAVPVIKWIGERMINYLNK

SEQ ID NO: 3893 - protein, 298 aa, H. influenzae strain 86-028NP
MYWFRNAIIYQLTKQIDFENIEKQLKECEFTPCGSADVSHFGWSAPLVTSENLAHQANGKILLVAKREEKILPVEVVNRELNKRITALEEKEQRKLKKVERSSLKDDVIATLLPQAFSRIKTTALYIDTLKQLIFVDAASSKTAEDALALLRKSLGSLLVVPLAFNCAPCEVMTRWVTDTAPDWLILRKEVEIREKEDLGVIHCKQKDVEDEEIIELVQNGLISKLALEWENNLKFVLIEDGTLKRLKFDDNITEQNDDIVKEDVTARFDVDFVLMASVLGKTVDSLIKEFGGIRDRL

SEQ ID NO: 3894 - protein, 448 aa, H. influenzae strain 86-028NP
MAEENKEIIAYKGFKQDWTCRGYQYEVGKTYEHKGNVKACESGFHACEYPLDVLSYYSPAVSKFAVVKMSGETSKDSDDTKIASAKITIETEINLPEMIKKAVEWIKGKVDWDAAKVSNTGDWSAATNTGDWSAATNTGDQSAATNTGNWSAATNTGDQSAATNTGDQSAATNTGYRSVATNTGYRSVATNTGDQSAATNTGGQSAATNTGDQSAATNTGYRSVATNTGDQSAATNTGYRSVATNTGDQSAATNTGGQSAATNTGDQSAATNTGYRSVATNTGDQSAATNTGNWSAATNTGDQSAATNTGDQSAATNTGYRSVATNTGDRSAATNTGYRSAATNTGYRSVATNTGDRSAATNTGYRSVATNTGDQSVAEISGKQSIAVALGWQSKAKASINGAIVCVYRNHDGELIHIKASKVGENNIKADTWYTLDEFGEFVEVKDD

SEQ ID NO: 3895 - protein, 144 aa, H. influenzae strain 86-028NP
MARNTNTVILVGHLGSDPEIRQFQNGGQIATFNLAIGDDYRDKQGNTVKRTHWIPIVVHGNSADVARQYLQKGSKICVTGKLVQESWQDQNGNNRTALKVATQSFEMLDSKANNETQQPSKDKEKPDPLSAAAEQDGFDDDIPF

SEQ ID NO: 3896 - protein, 214 aa, H. influenzae strain 86-028NP
MYQLKAKCSGLADLMVKPKSGNGISATAKSAVRKIVKFDLFGYRDFEGNKYTEKGIALEEQAIKLSGRKRGLPLKKNTERRENDWITGECDIYVPSRKLIIDTKCSWDIGSHPFFADEAEEKAKKAGYDAQMQGYMWLWDCSEAQIDFVLLPTPYDQLSSYDDPSRYIDLVEQIPQEKRITTVTIKRDEKVIEKIKERVEIAQEYYQQLIQEMR

SEQ ID NO: 3897 - protein, 306 aa, H. influenzae strain 86-028NP
MTNQVQHQQNKQPPALKTFFESANVQNKIKELVGKNAATFATSVMQIANSNAMLKTADPMSIFNAACMAATLNLPLQNGLGFAYIVPFRNNKEKKTEAQFQIGYKGFIQLAQRSGQFKRLVALPVYKKQLIKKDFINGFEFDWEQEPEQNENPIGYYAYFKLVNDFSAELYMSHDDIVKHAQRYSQTFKKGYGVWHDNFEAMALKTVTKLLLSKQAPLSVEMQQAVLADQAVVKDVENQEFNYTDNIQEAEFLAVVDEATFEQCKQSIANGETTLQELCDSGAYEFSQEQIAELEAIENGNVPTQS

SEQ ID NO: 3898 - protein, 97 aa, H. influenzae strain 86-028NP
MKPSDDYYYQLDAAHQRKVDWQAGYEIALDEVATEIDNDLQQGDQTHYHELTEMLCDNDNFWLAIGSGASYEPYRQEAIKKIAERELHDRMNDYDPD

SEQ ID NO: 3899 - protein, 114 aa, H. influenzae strain 86-028NP
MKHSKTPLRQEKQSFTHFMKGSEKWLNRICYFLAALIIAMIVGGISLHANAHPTDWHDNELSQQIQQETRCELKGGIYENGVCLPPNLTLAAEKELQAYTAQKQAEINRTWSKQ

SEQ ID NO: 3900 - protein, 245 aa, H. influenzae strain 86-028NP
MKTELFNDHFQNYKRYHIPKAQLVIADIPYNLGNNAYASNPEWYVNGDNKNGESDKANSSFFDTDKDFRIAEFMHFCSKMLIKEPKERGKAPCMIVFCAFQQISMVIDYAKQHGFKNHIPLVFIKSSSPQVLKANMKVVGATEYALILYRDKLPKFNNNGKMIKNWFEWEKDNRKEIPKLHPTQKPIAVLKRLIEIFTDEGDVVIDPVAGSASTLRAARELNRPSYGFEIKKDSCKIAKEKMLNI

SEQ ID NO: 3901 - protein, 343 aa, H. influenzae strain 86-028NP
MTSNAERFKFTDEHIAFIRLHWDKKPSDLIKLFQQQFDLLINRNVFYKLKKKHNIPSLKHANRYSKEELAFIKANCTLNERILAQKMEVYFNKPFNPHALKVLRVKRQWLTGRRGRFEKGENLKPIGFERYCKNAKCWLIKASIKRYERKSHYLWRKAGRKIPRGHIIDYKDGNSRNCTLENLELISRVEMAWRKKLQYHQLNDEIKPTFSAFVKLKEGINQRKKEKDMEENQSPNIATQEPTTFTFEFTEHELQTMAWAWFALLRGTELCQVLHPALKQIGSHYAASVYDIAYEYRSTLRHAHNVLTRITEQFECEQGNNWRVLKYLRAYDPKKTGFQLEIL

SEQ ID NO: 3902 - protein, 83 aa, H. influenzae strain 86-028NP
MKNKITDLNNHLFSQLEKLLDEDLTDEELNREIKRANAVSGIAANIIASNAISLKAMTLFENRQIERESPDFLRISKAQGDDL

SEQ ID NO: 3903 - protein, 103 aa, H. influenzae strain 86-028NP
MATIIVKRDAGSRKFTEKGEILQRGKAGRLERMFDKQRRINAAFEKMVVKESAADRAIKFAANRQKEQFIDIANYHCCKGKPAGTNTVHAVQKRRLGVRELIR

SEQ ID NO: 3904 - protein, 61 aa, H. influenzae strain 86-028NP
MNINSPAELKAFFITEVLERYAEKTGKALEALADLFMTNEDFRNLIMDEVEVEAKQVVAHI

SEQ ID NO: 3905 - protein, 382 aa, H. influenzae strain 86-028NP
MTDAILKDKILSHAQHVLRAGPHCTTEETTKQALILPFLDILGFTSYDPTKVKAEYTADFVGAKNGERVDYALFCHNVPVMFIEAKSYNEDLSNHAPQLARYFNATPEVAVAAITNGKEWRFFTDLKDKNIMDSTPFLRINFSSLDETKIPQLAQFCHDKFQPEALRTLAEESVYLSAFTKVISSSLKDVDSDFVRYIAGRSNIGRQLNQRFIESITPIVKQAVEKAVSEMVVSGLSKQPVMEQLEEPASEMIDETAPVVDPNNSKIVTTYTERLLSEYVSLILGEEVELIAKDTESYFSILYQGKTNRWILRYYDNKQRPSIVIPIELNDENRKEIVRAGLEISGSQIIIDCPENILRLSGIIRDCLEYCQDDENFRVKKK

SEQ ID NO: 3906 - protein, 286 aa, H. influenzae strain 86-028NP
MIPTYCVICQKSLANIKETKMKKAVLSSLILVALPFSTLAEDKIYNPSPQEIELMKLVIKEEIDVYFQGGKTAYKYGDYVFTTISELEKEYDKNEARANKKFKGKNLIVSGTIGSIETDLFDHPYIVFKSKNEFNFNATQAKFKKSAYDKVIDLNKSDKVNLVCEGAGEVAGTPMLDNCQFRADVIKSITDQYLADYNNLLTKGVDTSKVFLNKIVYIVARRAYITNGFSKCSKKITSDCLDKGVDKKKEKAIEDAAENNDFIPELKPLAEYLDFHYTPKDQRNNQ

SEQ ID NO: 3907 - protein, 121 aa, H. influenzae strain 86-028NP
MQTKHILDIKLTARRYGKWAREGVGINYPAIQPFLRKSTPDHGIPMLDDETAMRIHDATLIMRNVTPELYQVFMLRYVSNLSQGDVGREMRVSVPTIKSYLYAAHQSLKLLLTQNKCIFLA

SEQ ID NO: 3908 - protein, 195 aa, H. influenzae strain 86-028NP
MAKEYKCKMCGNYFIKIVSSLQKVCSPECAIKLSREQTRKAREKKDKQARIENRKKMTALKEKNKTKHELTKEAQVAVNKYIRLRDVGKECISCGTPLVAEQLGGGFDAGHYRSRGAAPHLRFYTLNIHGQCKKCNRYYGGNVQQYRLGLLDRLGSEKVEQIEADNRPRHYFPDDLRRIKQIFNKKCRLIEKRKG

SEQ ID NO: 3909 - protein, 61 aa, H. influenzae strain 86-028NP
MRSSDLIKELKSAGCTFVRHGKGDHQIWQSPITGKTFPVPHPKQHVPIGTLRSIKKSAGLL

SEQ ID NO: 3910 - protein, 142 aa, H. influenzae strain 86-028NP
MLFTIGIETPTNENEAYGITVPALFTEEYSCFSAADTLEEIPTQVTDAIHSILEMMFEDGIDINELQDKGYRHYQTQEDFNYCDTWLLLDVDISAYQGKRHRINISLPEYLIKRIDSRVASNPIYKDRSHFLAIASQKELRQ

SEQ ID NO: 3911 - protein, 169 aa, H. influenzae strain 86-028NP
MACSVDDIKKAHGKRTEGRLKIQMIKLQGGVLAPLDELESEELKSLKNGEQYEIEIIRTRNPAFHRKVFAFFKFCFNHWAADKTEWEHFDERKQFDTFRKHLTVLAGFYESTYNIKGDLRIEAQSLSYGNMEQAEFESCYKALISAAIKHIFNDTTDENTLNQLYAFFG

SEQ ID NO: 3912 - protein, 196 aa, H. influenzae strain 86-028NP
MTEQQFDKNTWQTPCYVFEWLSQRFGWFDLDGCATANNALTCHYIGEPNSDNDEHQSIADDFLMPIEQMLDVLLDEVAERCSAPLRIYVNPPYSNVTPYLQRAKELCDAGYLVVMLLNNDKSTQWYQNHIQGVANEVIDITGGRIAFINPVTGKEIKGNSKGQMVVVFDPTMEDFVTRSISLDFIKKVSGYIRMEK

SEQ ID NO: 3913 - protein, 211 aa, H. influenzae strain 86-028NP
MANSITQNQINTLPPERAQRAEETINWLFNELKSIFPGWRAAFETEADYLSAKKTWLRVLVREKITRPQLENGICEAEKSLDKFLPSVGLFVYWCKAYDYHALGLPNEAELYQRYNTFLGYARFNRDEFQYRSKVEFWLLKNLYEKCKKKSEEDTLKAIPKLLTEAAEKVRSNFPFEDIPKMIPAKPSFYDKAKADKARDSLMAMMKGALQ

SEQ ID NO: 3914 - protein, 260 aa, H. influenzae strain 86-028NP
MSVELMTKAFKSKTGNPLTKLVLVKLADNANDDGVCYPSYKRIAIQCEVSRPTAISHVKKLEAMKYLSIRERKTENGNATNVYILHPENWEILEPFTSKAALPPLVNELNHPSKAALPPLVNELNPEPSIEPSDNHHIKKTTQKSESEMLLEQFGITGQLAKDFIAHRKAKKGVINQTQLNRLQKQADKAGISICEAVEICIERNWQGFNASWDWRDEKLRPNLPHLGQSHPNKPKFDDTQTGWSAGMNFTVDGTQWQIP

SEQ ID NO: 3915 - protein, 77 aa, H. influenzae strain 86-028NP
MENTNPNEKISQSQCDRILRYLQSGKRLTSLEALDKFGCLRLSARILDLKNRWHQISDEFVHDARTGKVYKAYFMAV

SEQ ID NO: 3916 - protein, 150 aa, H. influenzae strain 86-028NP
MNSKDIQRTLHRDCKNASGGITTLALTLGKSPNILGNKLNVECENNHLSFIEALDLIEITNSTRTVAAIADKIDHLIVPMPKCASCCADVVQGFLDITTNAGKIGEQIKSAVHPNSDLGRELSNKEKQTISASIDALIESALCLKWELEQ

SEQ ID NO: 3917 - protein, 68 aa, H. influenzae strain 86-028NP
LINKTIKIAIDECGGQAKLAKLCSVAQPTVFAWLHRGGISGKYIPLIAKASNGKVTETDILRSLTKSQ

SEQ ID NO: 3918 - protein, 322 aa, H. influenzae strain 86-028NP
MTTLGERLKFLLIERNVTQAELAEMVGTTQGAISNIVKGETQKPRNILEIANALGVDPNWLKYGSTKMTKLSERLKALLVEKGINQTEFANMIGIAQPSMQKILAGETRNPRKIVEIAKELGTTPDYLLYGDMTVSHSTLENSQINNNQGQTVNNFFDSGSDELREMLHKQQISLKTKPTEEWVFALDVNRLAETDIINVHFPRPFEALHLSQDGMMDLLKLRSTANVAMITMFNESMSPVINKKDLMFVDTTCKQYAGEGIYLFVMNNELYVRRLYQTPSGVLNAVAENERVGSSFEIDDLSRLNVLGRCVRKFSIVAEDL

SEQ ID NO: 3919 - protein, 108 aa, H. influenzae strain 86-028NP
MPTKDPTNLESFLRWLPLVFIGLFAGVAKYASDIQAGKLHFSVGLFLCQVLVSMFAGWIGGLICLSSGLDSDLVYVGSGLSGYGGGAVLNAIWRGFFASKLGIKDEQI

SEQ ID NO: 3920 - protein, 134 aa, H. influenzae strain 86-028NP
MSKFKLSAASEEKLVGVHADLVKVVHRAIELSVVDFKVIEGKRTLERQKELFAKKATKTMNSRHLTGHAVDLVPLPVNWNDREPFKNVASAMFQAAKQLGVAIRWGGDWNMNESSNDERFYDGPHFELLRSVYP

SEQ ID NO: 3921 - protein, 129 aa, H. influenzae strain 86-028NP
MTWWLFVIKKLGLNVFSHGCKHFNKVVAVFAGVFILALLYMQHTNKLNIERQSAVIDSLHEKVIKRDKIIDELHEDVDEQRKIAEKRLAQEQLIREQSYAQIQSIKKILESNQCSRTVLPNGVADELRK

SEQ ID NO: 3922 - protein, 76 aa, H. influenzae strain 86-028NP
VLLTSCASKPEIEYRTLAFSPPVSLLAPCPIPSFHGSTFGETVEYALLLKQELRLCANKVDGVREYVKARESAAEN

SEQ ID NO: 3923 - protein, 319 aa, H. influenzae strain 86-028NP
MMNKDLNIEYISTDVLKPYVNNSRTHSDEQIDQICESIEEFGFTNPILIGENNGIIAGHGRLLAAIKLNLYTVPTIRLTGLSDIQKKAYVIADNSLALNAGWNFELLSLELNELKDLGFDIDLLGFDDDFLKSLDGDLLADISGDSNSKEKLDLKQAFLAPPFSILNSREGWWQDRKRKWKALGIDSGSGRDSGMQRGMNSMARYNSKEDTSMSESDDSIFDPVLCEILYSWFSPKGCQILDPFAGGSVRGIVASKLNRNYIGVDLRAEQIEANLKQRNLVCSNDELQPIWICGDSINIDKLANGVSADLVFSCPLMPI

SEQ ID NO: 3924 - protein, 139 aa, H. influenzae strain 86-028NP
LPPYADLEVYSNNPNDLSNMDYDNFKKAYFEIIKKSCDMLKDNRFACFVVGEVRDKKGNYYNFVGDTIQAFLEAGLSYYNEMILVNVCGTMPMRAATPFKGSRKIGKVHQNVLVFVKGNPKIAAEYCGDVDVYIPNEDN

SEQ ID NO: 3925 - protein, 73 aa, H. influenzae strain 86-028NP
MMKKIDVLKDLMAKNEWKKAISLASKFPRLGNAKDAIKSAQMAYTNPNFVRQIKKDPDKLIYQGIQALIAKYG

SEQ ID NO: 3926 - protein, 122 aa, H. influenzae strain 86-028NP
MSKKKTKPKIEIDLSMVESLAAQGLTNQQIADSLGISERTLQNRKKDNAEFAEAIKKGKAKGIAVVTNALMKKIKSGNVTAMIFFLKTQGGWKENNQLEIEMKKEKKLPTLAELFGDETDPD

SEQ ID NO: 3927 - protein, 438 aa, H. influenzae strain 86-028NP
MIKSCRYKILYGGRGSGKSWGVAQLLIEIAVRTKVRVFCGRELQNSMSDSVIKLIADTIEDLGYLEEFEVQRNAIYCLKTGSEFMFYGIKNNPNKIKSLEGIDLVWIEEAENVSNESWDILIPTIRKERSEIWVTFNPKNILDPTYQRFVIAPPKNSFVRKINYDENPYFPETLRLEMEECKERDYELYRHIWLGEPVADSDKVIIKPVWIECAVDAHKKLGFLPAGRKIVGFDVADDGVDSNANAFVHGSVVLRVDEWRGEDVIGSADRTRLNALEFGANEIVYDSIGVGAGVKAHYHRLDDKSIRINGFNAGGAVFEPDAEYVYGKTNRDMFANIKAQAWWRLRDRFYKTYRAITYEEQYPVDEMISLSSDIRDLEYLKAELARPYVDYDGNGRVKVESKKDMKKRGIPSPNKADALVMCFAPKEDVLSRFIGLGS

SEQ ID NO: 3928 - protein, 438 aa, H. influenzae strain 86-028NP
MAFNQDGYAEALGINHFARNSANSTALFDLTLYELGGLAARVVDMPADAAISRSIEIQGDQDDAISNEIERLKILPALADMVRWSRFFGGAVMVLLTDDGARLSEPLEPSRITRIDEVRVFDLSQISPTANRYSDPTKPNYGRYSSYRLNIGTIAGSLDSQVEIHESRLLFMGGDSLPERLKNGLHWIGRSAVRSVYPKIRDYQKSLMWASLILERKQQAVHKMKGLALAIDNGLEPVIRERINLVERGRSLLNGVAVDSEDDYNILNADLGGIVDVLDEFKVAISADVNIPVAILFGQSAKGMNATGQSDFESYYDLVESIQQHKIKPVLEKLIELLMFQKHIKPFENWKIKFPSLNTPTDKEIADVRKTNADAAKIELDRLINLVDSGALSTEELRVQIAGEFGIQADKLPQVDDDDVEKYQEEQKAKGVVVSSRN

SEQ ID NO: 3929 - protein, 270 aa, H. influenzae strain 86-028NP
MTMMLKSIKKNRKPKVWLFPHAIEREYVGYLRGVARNINTMVNQKLVEIRPHFQANIRQDSFSDTLERWLIELLQAVLIFVDEKEITQFVRGYIHQTANFNGKQFHKVLKSVYSVDVFTTEPWLDDALKIAEWENIRLIKSLPTQTLEKLRSRFTQAVRGGWRWESVVDDVKSILNTNEKRATLIARDQIGKLNGHLTKLRQQNIGVKSYIWRGMLDERERAPHVDREGKQFDWDNPPDDGHPGEPILCRCYAEAVFPEFEDLNGVIYAE

SEQ ID NO: 3930 - protein, 357 aa, H. influenzae strain 86-028NP
MVMRYDRRGIQARRDDNGFIYDTPILTRSGVFVYELPNGKTRREYRPPDEVFKADSLRAYKGLPITEDHHGLVTKNNAHLVVGSILTEGKQDGQNLTADIVIHNTKAVDFGKKELSVGYKVDIDETSGITEDGEPYDVIQRNIRPNHLAIVTVGRAGNAALNLDAADAVEFNEDGENPMSNTQTTLSDIRLDSGITYQAAPEVIVELNKLKQDAKDAVTAKDKEAARADAAEAKVKDLEAQVEQIKQDAVSQAKVRVELENVAKAHKVEVKADSTDRALREAVIKAIRQDNADLSQKSDGYIEAAFDIAVSDAKQRADAAGVQRQQLTPSATNQPTFTQDSQTKLTGRAAMIASRNQ

SEQ ID NO: 3931 - protein, 139 aa, H. influenzae strain 86-028NP
MSMYDQLQQKAFAGMKGDSRYDLVETFAAENEIPFGVVITQGTSATQAKLGGTKPIGIALHSHAVVGGYAKFDAVSVLRKGVAWCVVKDSEAITAGSAVSFDPASGKVAKTGTALPNATFKTAVVDCGKYGKLALVELA

SEQ ID NO: 3932 - protein, 333 aa, H. influenzae strain 86-028NP
MFNDALSENLGLFYWRKIMTDIRQDAFELNAIKTCLNAVGVFNQDAGLFTQRQLEFVRNKIYEEKLPGMNGLSLVPVSSESPEWAETVTERIYDMVGMAKVVANYADDLPRADVAMTERAVKVKNIGAAYGYNLQELKAASANQTDLPSSKARAARRAVEVKMNEIALLGDKEFGLNGFINHPNLGETSVTGGWKTATADAVLADLDNLHDTVVLQSKGVHQPTHLLLSLTDYQTLSSKYMNTADKVDVLTFFKRKHPNLTIQGLWELEKAGTGNKNLAICYEKSLDNLTLETPQDFTQLPAQERNLELVVNCVARVGGVFLRYPLSATKAEI

SEQ ID NO: 3933 - protein, 62 aa, H. influenzae strain 86-028NP
MIVRNIEARLIRVGGEFIAPNQEVEIADDAVGLDRLIERGVLIDVTPKAEDAKKDGKSKKQE

SEQ ID NO: 3934 - protein, 116 aa, H. influenzae strain 86-028NP
MSAYSLLNLFYPLSQQMPEDMVNKVLSVADNKRPDCLSDEKQDEAVAWYAAYLLAQSIESGVNAAGLRREREGDLEREYFSSSDKGGNAERFLAKYNELNNICVRLGAITVGSHCV

SEQ ID NO: 3935 - protein, 152 aa, H. influenzae strain 86-028NP
VSSVVKVKINNKGLEKELELINKIGKARVKVGVQADAGIHSESGESLVDIGIWNEYGTAHIPSRPFIRQTFEDNQQALAQYLGRVVENVAKGDDLVQELSKLGQWYQDKQKKTLTSYPWTPNAPSTRRRKKSSKPLVDTSQLVNSIRYKVEI

SEQ ID NO: 3936 - protein, 119 aa, H. influenzae strain 86-028NP
MQIFSSQSSFRKPYKILVRSDGEYVKGKWVNDGEIEQTLMASIQPLSSAEMDRLVVSMQGRRVSSAVKIYTDQKLTVAGENAHNVAVVLFDGERYEVISRASYHSGVLSHHRYVAIRVK

SEQ ID NO: 3937 - protein, 169 aa, H. influenzae strain 86-028NP
MLERLYDLLGDLSDRPFIRAYENGREPEKPFFTYELKFERTPEHFHYSAVNDEGNQTVKTHIDAVLELNYFGGNSLQALRDVCMRLSMQSCRERWLNDGVALIRIGRITHLAFLNEQREYEDRAMVELEIRYAASVQDIVGIIEQVEVTANIGRASEKNLIGVNKNGEN

SEQ ID NO: 3938 - protein, 357 aa, H. influenzae strain 86-028NP; identical to SEQ ID NO: 715

SEQ ID NO: 3939 - protein, 141 aa, H. influenzae strain 86-028NP
MALATYAPDEVSIVIGASIVSGFADGTFIDIEEMSDGVSSVAGADGEVARATSADPRKKVTLTLLQTSDTNDVLSELYAADKVSKNATFPIAVKDLRGRSLFAASTAWVVKSAKLELGKEVGSREWTLETADGKLFVGGND

SEQ ID NO: 3940 - protein, 160 aa, H. influenzae strain 86-028NP
MARSEIQIGESTFFVQKFSVMDQLRIFGDLQKTLVPSLAKVIGFSDEKPKDATSAQLAELAQKSAANFAQGLQDLSQQLSGQELVKLADMLIKPELVTVQRDDFNNGTDKKLSKTDFDLVFDDMSELIELVIFILQLNFSSFFTKFLARLGSVQELVKKA

SEQ ID NO: 3941 - protein, 50 aa, H. influenzae strain 86-028NP
MIAWRPFLAGKVTLTELNTAGLTDMGELLKINRLLDAVDAMEAKQMEKNR

SEQ ID NO: 3942 - protein, 805 aa, H. influenzae strain 86-028NP
MNAIRELVTLLRYKVDNSGLKAYVVQTQQAAKGIRSNLNNAVDGLRAKFSEAAVSAKGVGNNLKDAKNQILSLRNFVAGYFAMIAGGNVIKIADDWAAVDSRVKLATKSAEEHKYALSQIFDLSQRSGQDYLASADLFSKVNRSAGDLGLSLDDTLNLTEIIGQTMTIGGGDQGAQQAALMQLGQALGSGALRGDELNSIIEQAPRLANAIADSFGVPIGQLKDLGKEGKLTSKELAQGLLKQADKIQKEFDQMPKTFGRGMTILKNKAGQLIDVAVNKVSKLGAAFYNAAEWVTENIRLVGFLAGTVIGGKLMFALAASKKSLRQLLMMGARAVAPYLAMAAAAGVVALVLEDIYGWTQGDLSFTGALVGRYEVWADKFAALGKLADKLWINVRGLLKDLSRMAGVEINFDSWQAFATDVLEYIIAAVRNLINTVSGMVRIIRALINGDYAGAWSSAGDMIDGLSLKFLPLYSVGLMVLGGILSAVWALFSPFRAFFGLLKGGFRSVMFVAKPFIKVAKGIASPFIWAQKHFKLFSRVGSGAFSLLKRGAVKFTVYGLKAFKWLAIKGINGFFGILRAAVKFGVIFKSVVGTVVKGIFAIGRAMFMAVASNPILLAISAVIGLVILLVVYWDEVKAFAIAAWEAISTKAAEIWQSIITGASEMWDNITNKAAESWDNVKKDAGEKWNSVTTMFKNAWQKSIDTVVGWFNSLIPSWIRDLFSDGAKAEVKLSGEALTTPVSGHVSPQRLGYGGRPIFAPNQNMTQTNNFNIQGSANPSGVANAVSDKLSRGSSTSFGMGAIEYAG

SEQ ID NO: 3943 - protein, 190 aa, H. influenzae strain 86-028NP
MSNLTILNNSIRSYENLFSLNDLHVASGRKEKHRPNQFIRLETTQELIKEIQDEDLNAQICAFKTIRGTQGGTYACEELVLAYAMWISPKFHLIVLRAFLAMHRNEPKQLTLPLVSDELKQAMAKMVTYASQYANFQQAITGAQLEDQKRLVEFFFSSIPNGDSYLFVFNKNIQQDIQQASDLLHKLITQ

SEQ ID NO: 3944 - protein, 193 aa, H. influenzae strain 86-028NP
MSIVNLLFSALAGKRTTIGVLELDALLTENTSLSSQITEYPIEDGTVISDHITRESERLSLSGVITGTGTLFNVGLGKYKLIAAKETLRELHAKRELVTIVTGLDVYEDFAIESLEIERNSDDGERLNISAEFRKIQKVTLRKEEVPPEKAAPNAKGKAGQTKVKTGKAQTGKPTNTQAQKITKFGEWTGKKE

SEQ ID NO: 3945 - protein, 104 aa, H. influenzae strain 86-028NP
MITINLANKNDFITEVNLDDEVFFLHFSWNDTIGFWSLTIENAYNDELVSSIVILPNRPLIAPVRRDELPLGELIAVRDDNLQTIGRDDFINGKAVLIYIGVDE

SEQ ID NO: 3946 - protein, 318 aa, H. influenzae strain 86-028NP
MSYRFLRSYKLMIGKKGQKDAIVIEPPMRIEFDIEKDCEAEPNENTIKIYNLASTTRKTIEQPDMRCVLYAGYAQEGDVLLCSGDIATAYSYHEGADWVTELYVLDGLVEIRDTAVSLGYVGGVSSTQITNDIAAKMGVTVVGADNLKSRTWANGFSFYGAARKALDKVVAGTGLEWSIQNGELQIVNRNGVTKRSGYVLAKDSGLIGFPERTREAARSKKQDTPNKKKDEKFAFDRQARDGWNVKSLLLPMVNPCDKIKLESVTVTNWFRVEKIKHSGDSHSSDWQSELHLVDLNAPTKTQMETQSKHRKKRKKKDD

SEQ ID NO: 3947 - protein, 223 aa, H. influenzae strain 86-028NP
MTDILTALSEINVSLPGKIVSYDAETVRATVQPSIPKRLANGEVLNAPQIVNVPVMFPMADINGAVAQVTLPVKAGDGCLLIFSQRSLENWLSGSNDAPDDPRMFDLSDAFCVMGGNSRSPNADVENLCIKYGSGKIKIAPNGNITINSPDVRVTTDNFTVTATTSTFNGNVIVNGGISTAGNSGSVSVSGSLTTTGDVMADGVSLQSHKHKGDSGGTTGKPL

SEQ ID NO: 3948 - protein, 121 aa, H. influenzae strain 86-028NP
MIDLKLSGQHDLMIKDRKLVLVDGINQKAQQIKVVLLTFLGEWFLDTTIGLPYFDEILTKNPDNARIQSIFRKKIMGVKGVLAVERLSLEFHLKDRVLAVQFSARTNEGVVKDKVSIKRNG

SEQ ID NO: 3949 - protein, 478 aa, H. influenzae strain 86-028NP
MANYGLTRSGFVRKRMPEQLKELYENAKKMFGEDIDLSPETVMGMMLNIESERFAALWELIESVYSAMYPISATGANLDRAVSFTGVTRLQAEHSTVPVIFYGNAGVEIPQYTAVRNAGTQVLYYSDEDARIDSNQAAYARIELNSNTINTGDVFSVVVNGVTYRFTAMRSSSASIIQGLANQLKAISYADVSNDNVIIEISAQSIPHFSISVSQNLTLSRLGVRCMLSTESPSEDKADIGQMIELVNMIDGVVEVNNVVEGASGRLEESDIELYQRYHRGVWQNGAGTIDSLYANLSKVAGVHSLRIYENDADQTINGIPKRSLYAVVKGGLDTDIASTLLKFKPLGIGTHGQTEVTVRDSQNQPHLIKFSRPTKCYIWLKVTIETFVDEDEIARAGYIVSALNNILKYGKSLGVGADVIHQRLIAACIAVQGVGKVTVQIGKTNNITDPEPRYQEQNITIAPDEEAIFDPSIIVMS

SEQ ID NO: 3950 - protein, 204 aa, H. influenzae strain 86-028NP
MKDILTALNDDFKQLGRERLLSQFNYSPNLNAFLSLLLLPHHEIQATLKQMLTERHIDTAIGKQLDGVGDIVGMPRPFARVNGDWYFGFSGQSKAKPFSRAPIRDLATQTNSRDFNYMLDEHYRRLIKWKVIANHSHGTLDDVIEACRAIFLAERVSITEGQDADVHIAITRMAKNRLDAVEQEPVLWIPTAAGVKVTVEFINA

SEQ ID NO: 3951 - protein, 782 aa, H. influenzae strain 86-028NP
MKLKLIDLFKRITWAKNGDLTDFSQTNYEAGWAHLGDDTPTVQDFNYVQQMNDKKDQWLFNQLKAVLEKANIEPTEENVNSLRDAILALSKGYSNPKSLTADTVNFIDEQGHTHEIAKATLQQQGIVQLTNDTGLESESLALTAKAGKKLAQQTTQLQLNVSQNYIQNSKKSSAVNSESEDNVATSKAAKTAYDKAVEAKTTAESKVGLRGNESIQGTKSFESKIIGFRGIGVADSQTYANANHLLNMGANDGDGWIEYKKSNRVIGTIRIRANGELSYNNQKIYHAGAKPQFNTDIEGKPNTLAGYGIGNFKVEQGQGDANGYKTDGNYYVANGQNLPENGAWHIEVVSGGATNAVRQIARKANDNKIKTRFFNGSNWSEWKDAGGDGVPIGAVVSFPRAVTNPVGFLKADGSTFNQQSFPDLYRTLGDSNQLPDLTRSDVGMTAYFAVDNIPAGWIAFDSIRTTVTQQNYPELYRYLVGKYGSISNVPLAEDRFIRNASNNLSVGETQSDEIKKHVHKVRTHWVNSSDSNIFYDKTKTVIDSRLRTATTTDDNLSDNGFMHPLLDSPMATGGAETRPRAIALKLCIKAKNTFDDVQFWVKAFGVVENAGALDAGTLAQNMQALSERVEQKIEENKQSTLREITNAKADINQQFLQAQGNLSQIGTLKTVWQGNVGSGQITISEKCFGKTLILYLQSSVNHSLDDNNDIELVSFEVGAEIEGKKGGRVRWLDVREVNAHSNGGRPIYYVEVKRFDVTVDRDGTTIQIQNLAGRFVKRIDIR

SEQ ID NO: 3952 - protein, 200 aa, H. influenzae strain 86-028NP
MKVYFLKENLNSYQIFPIPQNLNDFVEMEVENESELETKQLIDFKSQYILVDRQPTELHKWNGNSWVVDKKKKTEIKRELIKNLVDSIDDTAANISARWTRFAEEYKEREAAAIAFKEANFAGEVSVYISSFATVAGLDNQSASLLILQQAESLRTLQQQLAVQRMRKYELKHEALSDEELQRIHDDIIGKMQTLAEAQQ

SEQ ID NO: 3953 - protein, 166 aa, H. influenzae strain 86-028NP
MIGAKIYLALYKGKKTGKNPSALLARLSDWLTRKLTKGVYSHCEIAVMKEVFVSGHHYETEVMYECYSSSIRDGGVRCKQIDVYDREKWDLIELEGVTEAQIKAYFDRTLGCKYDWWGALGIVLGIKQKRSKYFCSEWCFNAICGSESGWRFSPNQLAAIFNKEKS

SEQ ID NO: 3954 - protein, 149 aa, H. influenzae strain 86-028NP
LFSGQQVATFDDLFQHNFWHCIRQSDYPKADGYLDGVEIVKESFHTLLPKFSDDPKALFVLDPPYLCTKQESYKQAKYFDLIDFLRLVNITRPPYVFFSSTKSEFIRFMNYMLEDKVDNWQAFENAKRITVNAKLNYQVAYEDNLVYKF

SEQ ID NO: 3955 - protein, 87 aa, H. influenzae strain 86-028NP
MTNFQMRTEQEMMMELALIAVKEHDGFIVDGSQYSLPNECGQTFVYNTAFLDVRFVEDGRKDCVVRFTSTLAPFAPPFYCLLSELED

SEQ ID NO: 3956 - protein, 93 aa, H. influenzae strain 86-028NP
MTKRCDQPICIEYEECEPNKYGEIRKKIVGVKNRFTEKKIITKLKNWVIKSAKSALGSTALNSETTEQTRRIEPLGLVSITVTVQKLNIKLIY

SEQ ID NO: 3957 - protein, 61 aa, H. influenzae strain 86-028NP
LQINVDPNIAPHRIPYFEFDTKEYEDLSVFADAIPKLTGIGVQISESWVWDKLGIPEPQEG

SEQ ID NO: 3958 - protein, 222 aa, H. influenzae strain 86-028NP
VEVERPADKQGNREKTVGFKLPDGTIRVTDKGFDYNVGRLNYKPNLDLYPEKLAHAFAKVEMKGGEFKHDFELLAKHMAEMKQTLSLDGKKLTVDQMLQVRDSLTKNFKFAAGVLSAESKDLLKSKTGTVWLSDDTLIKQFNSRDGQDFGLESYALFPDLFNQPDIVLQDNDRFYFIKNFEKQRILGVIKHLSKFNEIFVLSAREINIKEVEKMKGKLAVIK

SEQ ID NO: 3959 - protein, 48 aa, H. influenzae strain 86-028NP
LHEYTPLNFKNQQLLPQIFMRAKGRSIRLIGLHVNLPEENKQEQMSLW

SEQ ID NO: 3960 - protein, 178 aa, H. influenzae strain 86-028NP
MEHKLEDIIAIFNQCFEEEYNTRLVKGGDEPIYLPANDEVPYNAIYFARGFYSSALHEIAHWLVAGKERRKLEDFGYWYEPDGRSEERQRDFEKVEVKPQALEWILATAAGFRYFASADNLNGNPGDTQPFKQAVYEQVKIYAEKGLPKRAEMLRKALVAFYGTEDEIDLAKFDVVRI

SEQ ID NO: 3961 - protein, 148 aa, H. influenzae strain 86-028NP
MRFTKTLFTTALLGASIFSFQSTAWADTLEQQFQQGSEATTRGDYQTTFKFLLPLAEQGNAEAQLMLGVMYARGIGVKQDDFEAVKWYRQAAEQGYANAQAILGFSYLLGQSGVQVNKSLAKEWFGKACDNGDQNGCEYYGKLNRGEL

SEQ ID NO: 3962 - protein, 58 aa, H. influenzae strain 86-028NP
MPTLQCEFWNVGQGLFSSGRIQMGDAPAFHWVYGLQVPHHGSKPILVNKNKRLSIHSI

SEQ ID NO: 3963 - protein, 219 aa, H. influenzae strain 86-028NP; identical to SEQ ID NO: 725

SEQ ID NO: 3964 - protein, 58 aa, H. influenzae strain 86-028NP
MPTLQCEFWNVGQGLFSSGRIQMGDAQAFHWVYGLQVPHHGSKPILVNKNKRLSIHSI

SEQ ID NO: 3965 - protein, 184 aa, H. influenzae strain 86-028NP; identical to SEQ ID NO: 727

SEQ ID NO: 3966 - protein, 58 aa, H. influenzae strain 86-028NP
MPTLQCEFWNVGQGLFSSGRIQVGDAQAFHWVYGLQVPHHGSKPILVNKNKRLSIHSI

SEQ ID NO: 3967 - protein, 183 aa, H. influenzae strain 86-028NP; identical to SEQ ID NO: 729

SEQ ID NO: 3968 - protein, 361 aa, H. influenzae strain 86-028NP
MMKDSIIAKLESLKERYEELEALLGDVSVISDQDKFRAYSKEYSQLEEVVKCFNRWTQLNQNIEEAEILLDDPEMKEMAQMEIEESKAEIEEVEQQLQILLLPKDPNDEYNCYLEIRAGTGGDEAGIFAGDLFRMYSRYAESKRWCVEMLSANESEQGGYKEVIVKVSGEGVYGQLKFESGGHRVQRVPKTESQGRIHTSACTVAVMPELPESEMPEINPADLRIDTYRSSGAGGQHVNTTDSAVRITHIPTGIVVECQDERSQHKNKAKAMSVLASRIVQAEQERQAAEQTDMRRNLLGSGDRSDKIRTYNYPQGRVTDHRINLTIYRLDEVMNGKIDELIQPIITEYQADQLAALSEQN

SEQ ID NO: 3969 - protein, 156 aa, H. influenzae strain 86-028NP
MSFLTLKGNKMIIENQKDAEFSSAFKSSQPAQASRFKRWLASMINGLVLWVMAGLGFALGDFAGVVGMIVYAGFQLYFMKTYGQTMAKRWLGLRVFNYHTNHPVEFGKYIGREIIDILLAWTSFLLIISGIVALVRDDRRSLTDLVAGTMVLKDEK

SEQ ID NO: 3970 - protein, 292 aa, H. influenzae strain 86-028NP
MNYKEWLAQAIVDLAQKNPTENSKIDALVLLQHATGKSRTQILAFDDTEIDEKVRLKLTALLDRRLKGEPIAYILGEKEFWSLPLNVSKSTLIPRPDTESLVEKALQIALEKLEENPPHFRILDLGTGTGAIALALASELEPICQKRHIPLEIIGVDLMPDVVALAQSNAERNQLNVEFLQSRWFDNITGKFDLIVSNPPYIDAQDEHLHQGDVRFEPLSALVANDAGYADLRHIIELASSYLNSNGVLLLEHGWQQGEKVRSIFQENHWEMVETVRDYSDNERVTLGFWKK

SEQ ID NO: 3971 - protein, 267 aa, H. influenzae strain 86-028NP
MKYYRRALYDKFVHFYLVISDDGSSEAQLRGKMGGLVRKARKKISPDWPKEEQIHQLLQLFYGDWGFHCDPEDYFYARNLYLPYVFEHRQGMPVTLGAMVFYLAEALDLPIYPVNFPTQLILRAEVRDEVAFIDPWDGTYISQEKLQQLYEGAFGFGAKIQPEELDRADLSLLYSRFEQLAKNALIREEHNDMAYHYIKNLMITDAENPYHIRDRGLVLAQMGAYPSALKDLEFFVEHCPKDPTAAFIRTQLLELKGEINKDTFPLH

SEQ ID NO: 3972 - protein, 284 aa, H. influenzae strain 86-028NP
MQNKIVKIGNIDVANDKPFVLFGGMNVLESRDMAMQVCEAYVKVTEKLGVPYVFKASFDKANRSSIHSYRGPGMEEGLKIFQELKDTFGVKIITDVHEIYQCQPVADVVDIIQLPAFLARQTDLVEAMAKTGAVINVKKPQFLSPGQMGNIVEKIEECGNDKIILCDRGTNFGYDNLIVDMLGFSVMKKASKGSPVIFDVTHSLQCRDPFGAASSGRRAQVTELARSGLAVGIAGLFLEAHPNPNQAKCDGPSALPLSALEGFVSQMKAIDDLVKSFPELDTSI

SEQ ID NO: 3973 - protein, 315 aa, H. influenzae strain 86-028NP
MKIVFLDSTAIPKHISIPRPSFEHTWTEYDHTSSAETIERAKDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKDLINTETLSKMKKGAFLINTGRGPLIDELALVDALKTGHLGGAALDVMVKEPPEKDNPLILAAKTMPNLIITPHIAWASDSAVTTLVGKVMQNIEEFVQQLHQK

SEQ ID NO: 3974 - protein, 393 aa, H. influenzae strain 86-028NP
MNFPISLYIALRYWRAKSADRFGRLVTNLASLGIVLGVMALIIVLSVMNGLEGYQKQQVLSSIPHAIVSEEQPISTEKTLENLPHFVQKAVPINTTNVIYQTAKGVSAGQIIGIQSFSDDPLVESFDQTKFNEILPRGEFKLVIGDQLAQKLGVNIGDKIRLMITENSQYTPFGRVPMQRLFTVSDIYYGYGEASGYEAFANITDIGRLMRIQPQQAQGYRLFLNDPFQITELPQHFPTQKITDWRVQKGEFFQAVRMEKNMMGLLISLIIVVAISNIVTSLSLMVVDKQGEIAILQTQGLTKSQVRSVFIYQGLLVGFVGTLLGAILGVLATLNLTDIVSAVNPQGVFLPTELSFVQMIFVIGFSLLLSLLSTLYPAYRAAKVEPAAALRYE

SEQ ID NO: 3975 - protein, 430 aa, H. influenzae strain 86-028NP
MMDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCVIEPLADLLKKKGSEIAALILEPVVQGAGGMYFYSPTYLVKAQALCKQYGVLLIFDEIATGFGRTGKLFAAEHAGISPDIMCIGKALTGGYLTLSASITTTEIAQIICSGEAKCFMHGPTFMANPLACAIAAESIRLLLESPWQQNIQRIEHSLKQQLSPLAEKDYVKEVRALGAIGVVEMKSAVNMKTLVPRFVEQGVWIRPFGKLVYVMPPFVIKDDELQKLTEGMILALIQEYEH

SEQ ID NO: 3976 - protein, 379 aa, H. influenzae strain 86-028NP
MDAFKQQLEQLSAQNQYRSIPDLVHQGRYIMRENRKMLNMSSNDYLGLASNENLRQSFLQQYGGNFPSFTSSSSRLLTGNFPIYTDLEELVAQRFQRESALLFNSGYHANIGILPALTTKSLILADKLVHASMIDGIRLSQCEFFRYRHNDYEHLKNLLEKNVGKFDRTFIVTESVFSMDGDVADLKQLVQLKKQFPNTYLYVDEAHAIGVYGKNGLGIAERANVIADIDLLVGTFGKALASMGAYVVCDQILKECLINQMRPLIFSTALPPFNVAWTYFIFERLPQFSKERSHLERLSAFLRQEVEHRTQIMPSQTCIVPYILGENEATLAKAKDLQEQGYYCLPIRPPTVPKGTSRIRLSLTADMTMDEVKQFVACL

SEQ ID NO: 3977 - protein, 215 aa, H. influenzae strain 86-028NP
VKTKFYDHQGEHLIVYFAGWGTPLDAVVHLILPTDHDLLICYDYQDLNLDFDFSAYRHIRLVAWSMGVWAAERVLQGITLQSATAVNGTGLPCDDSFGIPYAIFKGTLDNLTENTRSKFERRICGDKVSFERYQQFSARPFNKIHQELTALFAMIQQDKRTNLIHWTNAWVSSRDKIFTPANQNQYWASRCAVQKIEGEHYVFSRFTHWSALWNH

SEQ ID NO: 3978 - protein, 260 aa, H. influenzae strain 86-028NP
MESLTSVNKSRIQQAFQKALNSYDEHALIQQKMNIKLMMHLQDYLPNGSLDSVLELGCGSGMLSTLLQKQISANYWLFNDLCDVRTLLTEKLIQPFDFYCGDAENFPFQRRFDLIASASAVQWFHQPDAFIAHCKTGLKTNGLLAVATFGEDNLKEVRQITNIGLNYPTLSQWQNWLANDFELLWCEDFNVILDFDTPLDVLKHLKYTGVTATNQKNWTRKNLNGFIGDYLSAFSMPSDKVRLTYHPLFFIARYSHIENQ

SEQ ID NO: 3979 - protein, 213 aa, H. influenzae strain 86-028NP
MGKVIFISGIDTDVGKTIATGIYAKKLMEQGCSVITQKMIQTGCKNIADDLLVHRKIQDIDLTEEDLQGKTCPYVFEYPCSPHLAAKRESRKIEAKILEKSTALLAEKYDYVLLEGAGGLMVPYCEEETTLDYIQLNNYPLILVTSGKLGSINHTLLSLEACRTRGISVLSVMYNGYPEYDPIISQETQRYLKRYLEKHFPETGFEYFGCIEI

SEQ ID NO: 3980 - protein, 227 aa, H. influenzae strain 86-028NP
MNNYLLKCENINKFYQEGENQTQVLKGVSFSMEPAELVAIVGSSGSGKSTLLHTLGGLDQPSSGEVFINGQSLQKASANELAALRNRYLGFVYQFHHLMADFTALENVMMPMLIGHQNKTEAKDRAEKMLSAVGLSHRITHRPSALSGGERQRVAIARALVNNPSLVLADEPTGNLDHKTTESIFELIQQLNQEQNIAFLLVTHDMGLAEKLSRRLVMQDGLLKEGA

SEQ ID NO: 3981 - protein, 416 aa, H. influenzae strain 86-028NP
MNTPFFISWRYQRGKQKNPLVALIAKFSAIGIALGVAVLIVGLSAMNGFERELNQRILAVVPHIEIFSAHQAKDPTIHHWQNLEKRLQQNPQIKGISPFVSFTALVENGSKLKVVQVKGVEKQAEDKVSSIGNFVQEQGWNKFEKEGGLVLGAGIAKELDVKVGDWITLLISQQNGDEQFAQPTREPVQVTAILRLDGQLDYSYALLPLAQAQTFLTYQPDQITGVELKLDDPFSARNLDLSMLNDYPQMLYMQNWISKFGYMYRDIQLIRTVMYIAMVLVIGVACFNIVSTLIMAVKDKQGDIAIMRTLGANNAFIKRIFIWYGLQAGMKGCLIGIVLGIILALNLTTFIQGIEWVIGKKLLSGDVYFVDFLPSELHWLDVLMVLVAALALSLMASLYPASRAAKLQPAQVLSSH

SEQ ID NO: 3982 - protein, 362 aa, H. influenzae strain 86-028NP
MAKEKIEIVVANDDTRIEKVDQVLPPIALLEKYPASEQAAALVKQTRHEAHNIIHGKDDRLLVVIGPCSIHDPKVAIEYATRLKPLREKYKDSLEIIMRVYFEKPRTTVGWKGLINDPYLNDTYRLNDGLRIARKLLSDINDLGVPAAGEFLDMITPQYLADFMSWGAIGARTTESQVHRELASGLSCAVGFKNATNGGVKVALDAIGAAEAPHYFLSVTKFGHSAIVSTKGNEDCHIILRGGDKGPNYSAEDVEKVCADIEKTGRIPHVMVDFSHANSSKQYKKQMDVCQDVCNQIAFGSKQIFGVMVESHLVEGRQDLVDGKAQTYGQSITDACIGWEDSERLLQQLSDAVIARRKATSN

SEQ ID NO: 3983 - protein, 146 aa, H. influenzae strain 86-028NP; identical to SEQ ID NO: 701

SEQ ID NO: 3984 - protein, 414 aa, H. influenzae strain 86-028NP
MNTSRLFSLLFQGSLVKRIAAGLVLGIVVALISAPLQETIGFNLAEKVGVLGTIFVKALRAVAPILIFFLVMAALANRKIGTKSNMKEIIVLYLLGTFLAAFVAVIAGFVFPTEVVLATKEDASSAPQAVGQVLFTLILNVVDNPLNAIFKANFIGVLAWSIGLGLALRHASDATKNVLSDFAEGVSKIVHVIISFAPFGVFGLVAETLSDKGLVALGGYVQLLAVLIGTMLFTAFVVNPILVYWKIRRNPYPLVWTCVRESGVTAFFTRSSAANIPVNIELAKRLNLDEETYSVSIPLGANINMAGAAITITILTLAAVHTLGLEVSFVSALLLSIVAALCACGASGVAGGSLLLIPLACSLFGISDDVAAQMIGVGFIIGILQDSTETALNSSTDVLFTAAVCMEEERKNAA

SEQ ID NO: 3985 - protein, 202 aa, H. influenzae strain 86-028NP
MNHLIIFAHPNSVRSFGRAIANRIEQISQENGVNVFFRDLYEMNFNPILSHEELQNANKGIIPEDIQQEHDFILQADLITLVYPLWWMGFPAILKGYLDRVLSHGFAYKTENGESVGLLKNKQMQQFITIGSNVDQYKEFGVDKSLNHCLINGLFNYCGIENVEFELFGDIHLIDDEARKAMIELAAQKTQAKLTALLKEKE

SEQ ID NO: 3986 - protein, 184 aa, H. influenzae strain 86-028NP
MSEKQINNFSLISRLFGNLFYRSPTDKVLADAFVWLQQKGLSQVWALDTDKESELALNSLQVKIDLNLLNEEYQKLFGANGKVMTAISAYGIDVEEFVNFRLVRNMPEVESADHFALLLLTASWLEDNSDSLVAQQEFFETFLLPCAAKFLTQVETQATLPFYRALALLTREILAAMADELEEE

SEQ ID NO: 3987 - protein, 184 aa, H. influenzae strain 86-028NP
MDALTLLTTRKSNKKLTVPAPNAEQLERIFEAAMRVPDHGKLHPYHFIVMENESLNKLETLLKAAVVEFDLGEEKLMKAENLAHRAPMVIGVVAKIDPTIAKVPDWEQMLSAGCATYGLQLAAQAQGFDNVWISGKWVNGTALREAFGCREQDRVIALVMIGTSMEKAERECRIIDTKDFVTYL

SEQ ID NO: 3988 - protein, 615 aa, H. influenzae strain 86-028NP
MFRVLKFCWKVLCFIRDLVMNVVFLGFVLLLVAIISFSSGGKKSTALTSEGALLLNLDGYLADNRDETLRWQDALSELNGEHVPRKISTFDVVFAIQQAEDDPKIKGLVLDLNYFEGADLPALDFIGGAISHFKDAGKPVIAYADNYSQGQYYLASFADEIYLNSIGSVDIHGLSQENLYFKEMLDKLAVTPHIFRVGTYKSAVEPFLRNDMSAEAKANMQRWLGEMWNNYVLSVSENRNIKKDRILPNAKQYLAELKALKGNSTAYAQQRGLVTDVVTRLDLDKKFTALFGKGSDGKANLIEFDDYLTQLPDRLEHYNVPNKIAVVNVEGTIIDGESDEENAGGDTIARILRKAHDDNSVKAVILRVNSPGGSAFASEIIRQETENLQKIGKPVIVSMGAMAASGGYWISSTADYIIADANTITGSIGIFTMFPTFENSIKKIGVHADGVSTTELANTSAFSPLAKPVQDIYQTEIEHGYDRFLEIVSKGRQLSKTQVDKLAQGQVWLGSDAFQNGLVDEIGSFNEAVNKAEQLVNQRQDTAVQDFSVEWFTDDNVSLISTLLRDTKKGTQEQLVKWLGLPAPIQKLQKELNVLTKFNDPKGQYLYCLNCGKVQ

SEQ ID NO: 3989 - protein, 265 aa, H. influenzae strain 86-028NP
MKKLTLREQQLVCLNILDYFHALCERHQIHYSLGGGTLIGAIRHKGFIPWDDDIDVYMHRDEYQRFVDVWFQETHEYYNMETAEDILAQYTGEMAKIFDCRTQITDAKGRKSPMFMDIFIYDGVPNEPKIIYPLMKKHRRIKLRFSSCKKRWLRSKENTLQRTILGKLSHFLFSKMQKNLAQFQIKYPIKQCDYIGLVLSDYGGWQKSYMPKEYFNHIVYKEFEGRQFQVMNGYHEHLTQYYGDYMKLPPEEDQKPHHIQEAYIL

SEQ ID NO: 3990 - protein, 233 aa, H. influenzae strain 86-028NP; identical to SEQ ID NO: 634

SEQ ID NO: 3991 - protein, 292 aa, H. influenzae strain 86-028NP
MRGYLFGILSAVFWALSGLLYNELPLSEYDALGKIISLLFLIDFCSLLVIGITLWRKSAVDFQGVFWQPALSGVLGGPIGMSAYLLSIHYLTIYYAAPLSSLFPVFAALMSYWILKEKISRTAQFGFGLAVIASALLAIEVGQKANFNTSGLIFLAICILGWSSEIVISSYTMRSLSGLQVYFLRLCGSTIGYLLILFILSLKNFSLDILSFNYVQIAGVIIFGALSYCCYYQAIYLLKPIKAMALNITYSVWAIGLGYLLYKQPIKPITLLLTLLLSAGVIVTLYYKGEQK

SEQ ID NO: 3992 - protein, 319 aa, H. influenzae strain 86-028NP; identical to SEQ ID NO: 711

SEQ ID NO: 3993 - protein, 670 aa, H. influenzae strain 86-028NP
MTFSVQHAEIHFNRNHIPVSDQFNDVYFSNENGLAETDYVFLQGNQLWERWISHNEANFVIAETGFGTGLNFFAVTQLFREFRQQHENHPLKRLNFISFEKYPLKITALSQAHLAYPQFEDLSAHLQRYWPSLILGCHRIHFGETTLDLWLGNVSENLPQLGDYMNERIDAWFLDGFAPSKNPEMWNDDLYKLMFRFTKPNGSFATFTAASAVRKGLESAGFNVTKRKGFGKKRECLSGLKIQSKSTVLSTPWYLAQPAKMEKQDVAIIGGGIASFCAAISLVKRGAKVTIYCEDDALALNASGNKQGAFYPQLSDDNALTVDFYLHAFSYGRQLLDWAIEQNIEFEHEFCGVALCAYNEKSAVKLTKISQLGLPNEIFQMLSAEQLSEKVGLPLNCEGGWIEQGAWLAPRQFVQNAFSFLEKQGVIIKTSQKITALSQQEKGWELENTQGQKYCHEVVILANGYKITDFVQTEKLPLYPIRGQVSQIPTSENLLKLKSVLCYDGYLTPANQLKTSHCIGASHVRDNVDRHFSEQEQQENQQKLQQNIAQPWTQDVNTSDNLARVGIRCSVRDLAPMVGNVPHFEQQQADYYNLFNLRRRKQPIQSAANFQNIFLIAALGSRGLTSAPLLGETLASIIYGEPLPISEGILHNLSANRAWVKKWLKGSKVE

SEQ ID NO: 3994 - protein, 406 aa, H. influenzae strain 86-028NP
MRRAVITGFGIISSIGNNKEEVLASLKEGKSGIEVVPEFVEMNMRSHVAGTIKLNPSEHIDRKVFRFMGDAAAYAYLSMREAIEDAGLTEDQVSNDRTGLVIGAGTGSAHNQLVACDAVRGPRGVKAIGPYAVTKTMASSVSACLATPYKIRGVNYSMSSACATSAHCIGHAVELIQLGKQDIVFAGGAEELSWECATEFDAMGAVSTKYNETPEKASRAYDANRDGFVIAGGGAVVVVEELEHALARGAKIYAEIVGYGATSDGYDMVAPSGEGAERCMKQAMATVDTPIDYINVHGTSTPVGDVKELGAIKNVFGDKIPAISSTKSMTGHSLGAAGAHEAIYTLLMLDNDFIAPSINIETLDEAAEGCNIVTETKENAGLQTVMSNSFGFGGTNATLIFKRYNG

SEQ ID NO: 3995 - protein, 87 aa, H. influenzae strain 86-028NP
MFVVIFGRPGCPYCVRAKNLAEKLKGEVADFDYRYVDIHAEGITKEDLSKSVGKPVETVPQIFIDEKPIGGCTDFEALMKEQFGIVA

SEQ ID NO: 3996 - protein, 302 aa, H. influenzae strain 86-028NP
MKLLMLCREPRLYSCQRLKEAAKRQGHEMDILDPNRCLLKLSQNPPHFQIFYQENSGSKPYLLPDYDAVLPRFGTTSTQMGCSVLQHFEGKGTFCLNLSQAFLNARDKWKSLQLLLKTGVPVPNSFLSGGEVQAQATIPHISSPTILKMLNGSQGIGVILAEKPQSAVSIMEAFKQTNISMLQQDFIEEAGNADIRCFVIGDQVVATMQRIGQDGEFRANCHRGGKTEKIILSDDEKQIAIRATKAIGLDVAGVDLIRSKNGLLVLEVNASPGLEMIEKTSGVDIAAEIIDYIEINAFINLR

SEQ ID NO: 3997 - protein, 404 aa, H. influenzae strain 86-028NP
MSYTFSTYETLALASLVLLLGYFLVKRINVLKTFNIPEPVVGGFIVAIGLLIWHKIDGTSFNFDKNLQTTMMLVFFTSIGLSANFSRLIKGGKPLVVFLFIAALLIFGQNVIGIASSMALGIHPAYGLLAGSVTLTGGHGTGAAWADTFAHQFNLQGATEIAIACATFGLVFGGIIGGPVARFLLNRQKQGENPENDEVDDIQEAFEHPTYKRKITARSLIETIAMISVCLLIGQYLDVQTKGTALQLPTFVWCLFTGVIVRNILSNIFRFQVAESAIDVLGSVGLSIFLAIALMSLRLWELAGLAIDVLIVLAIQVAFMAAFAIFITYRAMGKDYDAVVLSAGHCGFGLGATPTAIANMQAVTSRFGPSHKAFLIVPMVGAFFIDLINAALLKVSFAVVNMLA

SEQ ID NO: 3998 - protein, 747 aa, H. influenzae strain 86-028NP
MTNINYEGIEQMPLRTFTEKAYLNYSMYVIMDRALPFIGDGLKPVQRRIVYAMSELGLNATAKYKKSARTVGDVLGKFHPHGDSACYEAMVLMAQPFSYRYPLVDGQGNWGAPDDPKSFAAMRYTESRLSKISEILLSELGQGTVDYQPNFDGTLAEPQYLPARLPHILLNGTTGIAVGMATDIPPHNINEIADAAVMLLDNPKARLDDVLEIVQGPDFPTEAEIISPKSEIRKIYEQGRGSIKMRATWKQEDGEIIISALPHQSSPSKVIAQIAEQMTAKKLPMLEDIRDEADHENPIRIVLVPRSNRVDTDALMAHLFATTDLEKNYRVNMNMIGLDHKPAVKGLLEILNEWLDFRRTTVTRRLQYRLDKVLSRLHILEGLMIAFLNIDEVIEIIRHEDDPKAELMVRFNLSDEQADAILNLRLRHLAKLEENQLKAEQDELEKERLNLEAILGSERRLNTLIKKEIQEDAKKYASPRMSQLVEREEAKMISESDMTPAEPVTVILSEMGWVRCAKGHDIDPKSLSYKAGDSYLAHACGKSNQAVVFIDSTGRSYALDPLSLPSARSQGEPLTGKLNLPTGATIEYVVMASEQQELLMASDAGYGFICKFEDLIARNKAGKALISLPENAKVLKPKTLINSTALVVAITSAGRMLIFPAQDLPVLSKGKGNKMITIPAANAKDRSELLTKLLLISDQASLEFYSGKRKIVLKPEDLQKFRAERGRKGSTLPRGLHTNLEIMVVEP

SEQ ID NO: 3999 - protein, 632 aa, H. influenzae strain 86-028NP
MTTNYSAQEITVLKDLEPVQIRPGMYTDTTRPNHLAQEVIDNSVDEALAGFASKIEVILHPDQSIEVTDNGRGMPVDTHPTEGVSGVEVILTKLHAGGKFSNKNYEFAGGLHGVGISVVNALSERVDIQVKRNGEIYKIAFENGSKVEELEIIGTCGRRTTGTTVHFKPNPKYFDSAKFSVSRLRHLLRAKAVLCSGLEIKFIDKVNNTQDIWLYEDGLSDYLIEAVNGFETLPEKPFVGEFKGTNEAVSWALLWLPEGGELIGESYVNLIPTIQGGTHVNGLRQGLLDAIREFCEFRNLLPRGVKLTADDIWDRCSYILSLKMQDAQFAGQTKERLSSRQSAVFVSGVLKDAFSLWLNQNVQDAEKLAEIAISSAQRRLRAAKKVVRKKLVSGPALPGKLADCGSQDLEKTELFLVEGDSAGGSAKQARDREYQAILPLRGKILNTWEVSPDQVLGSTEIHDIAVALGIDPDSNDLSQLRYGKVCILADADSDGLHIATLLCALFLRHFPKLVQDGHVYVAMPPLYRIDLNKEVFYALDENEKEAILDRLKNKKGKPNVQRFKGLGEMNPSQLRETTMDPNTRRLVQLTYDLGEDQGSDTLELMDMLLAKKRSEDRKNWLQAKGDQVDLSV

SEQ ID NO: 4000 - protein, 311 aa, H. influenzae strain 86-028NP
MKNEKLPQFQPHFLAPKYWLFWLGVAIWRSILCLPYPILRHIGHGLGWLFSHLKVGKRRAAIARRNLELCFPDMSENDREAILQENLRSVGMAIIETGMAWFWSDSRIKKWSKVEGLHYLKENQKDGIVLVGVHFLTLELGARILGLHHPGIGVYRPNDNPLLDWLQTQGRLRSNKDMLDRKDLRGMIKALRHEETIWYAPDHDYGRKNAVFVPFFAVPDACTTTGSYYLLKSSQNSKVIPFAPLRNKDGSGYTVSISAPVDFTDLQDETAIAARMNQIVEKEIMKGISQYMWLHRRFKTRPDEKTPSLYD

SEQ ID NO: 4001 - protein, 476 aa, H. influenzae strain 86-028NP
MAQYSAEFKQAKVLVLGDVMLDRYWFGATNRISPEAPVPVVRVQENEERAGGAANVAMNIASLNVSVQLMGLIGQDETGSALSLLLEKQKIDCNFVALETHPTITKLRILSRHQQLLRLDFEEDFNNVDCKDLLAKLESAVKNYGALILSDYGKGTLKDVQKMIQIARKANVPVLIDPKGTDFERYRGATLLTPNMSEFEAVVGKCNTEEEIIKKGLKLISDIELTALLVTRSEKGMTLLRPNQEPYHLPTVAKEVFDVTGAGDTVISVLATALADGRSFEESCYLANVAAGIVVGKLGTSTVSTVELENAIHARPETGFGIMSEAELKDAVAQAKARGEKIVMTNGCFDILHPGHISYLENARKLGDRLIVAVNSDDSVKRLKGESRPINNLENRMAVLAGLASVDWLVPFTEDTPQRLIGEILPDLLVKGGDYKPEEIAGSKEVWANGGDVKVLNFENGCSTTNVIEKIKLLKD

SEQ ID NO: 4002 - protein, 118 aa, H. influenzae strain 86-028NP
LHYIAEIRNECGSYASHGQDIEHKQISSDLALFVLHSTNAILGFILHFYIATNDYRRSERIQYEDNQRINELIDEAYEMETIYKISYSQALFAQDPDTYREMVLEFEQIEYERLMDTL

SEQ ID NO: 4003 - protein, 134 aa, H. influenzae strain 86-028NP
LDVEVIEWLENFLLDFQGSIVFISHDRSFIRKMATRIVDLDRGQLQSYLGNYDLYLTTKEENLRVEALQNELFDKRLAQEEVWIRQGIKARRTRNEGRVRALKAMREERQLKPYRGENEIVYYSQNCCSNQIIY

SEQ ID NO: 4004 - protein, 186 aa, H. influenzae strain 86-028NP
LILDEPTNDLDVETLELLEEILTDYQGTLLIVSHDRQFIDNTATECYLFEGEGHLNKYVGGFFDAKQQQANFWASKAVEEQAKAKKTEPLKEESAVKNDRTSKPKSVKLSYKEQRELEQLPQLLEELETKITVLQAEIADPAFFQQAHDITDAKLKALADTEAELETAFLRWEELEEKKNLADGKA

SEQ ID NO: 4005 - protein, 229 aa, H. influenzae strain 86-028NP
MDKIKQLFANNYSWAQRMKEENSTYFKELADHQTPHYLWIGCSDSRVPAEKLTNLEPGELFVHRNVANQVIHTDFNCLSVVQYAVDVLKIEHIIICGHTNCGGIHAAMADKDLGLINNWLLHIRDIWFKHGHLLGKLSPEKRADMLTKINVAEQVYNLGRTSIVKSAWERGQKLSLHGWVYDVNDGFLVDQGVMATSRETLEISYRNAIARLSILDEENILKKDHLENT

SEQ ID NO: 4006 - protein, 502 aa, H. influenzae strain 86-028NP
LFIARTNTIFLWKISFIKVNCRQFYVNYIQLQRFNMSKVASIVDVLQGKVAIGETVTVRGWVRTRRDSKAGLSFLAVYDGSCFDPIQAIINNDIKNYESEILRLTTGCSVIVTGKVVESPSEGQAVELQAEKVEVTGFVEDPDTYPMAAKRHSIEYLREVAHLRPRTNIIGAVARVRHCLSQAIHRFFHEQGFYWVATPLITASDTEGAGEMFRVSTLDLENLPRSENGKVDFSQDFFGKESFLTVSGQLNGETYACALSKIYTFGPTFRAENSNTTRHLAEFWMVEPEVAFATLADNAKLAEDMLKYVFRAVLAERKDDLQFFEKHVDKDVITRLENFVNSDFAQIDYTDAIDVLLKSGKKFEFPVSWGIDLSSEHERFLAEEYFKSPVVVKNYPKDIKAFYMRLNDDGKTVAAMDVLAPGIGEIIGGSQREERLEVLDKRMEEMGLNPDDYWWYRDLRKYGSVPHSGFGLGFERLIVYVTGVQNIRDVIPFPRAPRNANF

SEQ ID NO: 4007 - protein, 157 aa, H. influenzae strain 86-028NP
MKVLEGSVAAPNAKVAVAIARFNSFINESLLEGAIDALKRIGQVKDENITIVRTPGAYELPLVARRLAESKKFDAIVALGTVIRGGTAHFEYVAGEASSGLGKVAMDAEIPVAFGVLTTENIEQAIERAGTKAGNKGAEAALTALEMVNLIQQIDAA

SEQ ID NO: 4008 - protein, 144 aa, H. influenzae strain 86-028NP
MTEQKQVKKPSARRRARECTVQALYSWAVSGNTAEQVELAFVLDQDMDGVDKPYFRKLFRQTVENIETVDFSISPYIDRAFDELDPIETAILRLAVYELCFELDVPYKVVINEAIEVAKVFGADESHKYINGVLDKIAPALGRK

SEQ ID NO: 4009 - protein, 328 aa, H. influenzae strain 86-028NP
MAMGEFDLIKRYFQQQILVDDSVQLSIGDDCALVSVPENYQLAITTDTMVENTHFLPTISPEDLAYKAVATNLSDLAAMGAQPKWVSLALTLPNVDENWISTFSQSLLHTLKQYNVTLIGGDTTKGNLSITITAQGFVEKNKGICRHKAQIGDLIYVSGTLGDSAAGLTQILLGKSAVDSDDVFLQQRHLRPTPRIELGRALIDIAHAAIDLSDGLISDLGHILERSQCSAEVELTALPLSSSILNKYDRTQAEQFALSGGEDYELCFTIPPEYKDELELRLKKLNVPCTCIGKINEKCGDFSPRFLRDGKPVNIIFSSGFDHFKESK

SEQ ID NO: 4010 - protein, 163 aa, H. influenzae strain 86-028NP
MTENNPLKKISLLNPIHLLAVGFGSGLIYPAPGTWGSLAGTILGVILLSLLGVKIFLIFTALCFLLGCYLCQKTTADMGVHDHGSIVWDEFVGVFIVLAAIPSLSWQWILAAFALFRFFDILKPFPIRYFDEKLENGFGIMIDDVLAAIYAVIVVFAIQYWML

SEQ ID NO: 4011 - protein, 209 aa, H. influenzae strain 86-028NP
MLNLIIVHLFGLMTPGPDFFYVSRMAASNSRRNTVCGILGITLGIAFWGMLSMLGLAVLFVTIPALHGVIMLLGGSYLAYLGFLMARSKKYAQFEPHSDTEFNQQTTIKKEILKGLLVNLSNAKVVVYFSSVMSLVLVNITEMWQIILAFMVIVVETFCYFYVISLIFSRNIAKRLYSQYSRYIDNMAGIVFLFFGCALVYNGINEIIH

SEQ ID NO: 4012 - protein, 270 aa, H. influenzae strain 86-028NP
MTLKIAIAGAGGRMGRQLIQAVHSAEGVELGAAFERKGSSLVGTDAGELAGIGHLGVAVSDDLESQKDKFDLLIDFTRPEGSLEHIAFCVANNKKMVIGTTGFDQNGKAAIKAASDKIAIVFASNFSVGVNLVFKLLEKAAKVMGDYCDIEVIEAHHRHKVDAPSGTALSMGEHIAKTLGRDLKTHGVFCREGITGERKRDEIGFSTIRASDVVGEHTVWFADIGERVEISHKASSRMTFANGAVRAGKWLENKANGLFDMTDVLDLNNL

SEQ ID NO: 4013 - protein, 82 aa, H. influenzae strain 86-028NP
MKIHLIRHNTTLEFNNETSLLDHLEKNNIHHEYQCRSGYCGSCRVKIKKGKVSYKEMPLAFIQPDEILLCCCHVESDLEIDL

SEQ ID NO: 4014 - protein, 246 aa, H. influenzae strain 86-028NP
MKLLIKTSLSQWICLNFAKIPIFKMLGFITALFITACSSISKEPVKTVDIYIKPYYSAENGKAENVFVHKEIDPMLRENTLKGYKSTVKFLEENPARISPMTMFTLAARAYDFGLRDEAVTWFYRGQNRLITALYVLDLPKQTVQDNTGFSHVVGQFVNAYAFCDFDKQSRAAENAVKWTIAHPYEVVFLPALPAKFADRQKALKESEEKLVQRLQEQARFFANPKNKEKWQKKRSENFVNERFCW

SEQ ID NO: 4015 - protein, 329 aa, H. influenzae strain 86-028NP
MQHLNELVEKAKLAIESIQDKSLTALDEIRVEYFGKKGYFTQLMQELRNVSAEERPAMGAKINEAKQAALEFLNAKKTEWEQAELNAKLEKERVDVSLPGRKVETGGLHPVTMTINRVTKFFSELGFSVENGPEIESDYYNFDALNIPKHHPARADHDTFWFNPELLLRTQTSGVQIRTMEKMQPPIRIMAPGRVYRNDYDQTHTPMFHQIELLYVDKKANFTELKGLLHDFLRAFFEEDLQVRFRPSYFPFTEPSAEVDVMGKNGKWLEVLGCGMVHPNVLRNVGIDPNEYSGFAVGMGVERLTMLRYNVTDLRSFFENDLRFLKQFK

SEQ ID NO: 4016 - protein, 795 aa, H. influenzae strain 86-028NP
MKFSEQWVREWVNPAVSTEQLCEQITMLGLEVDGVESVAGTFNGVVVGEVVECAQHPDADKLRVTKVNVGGDRLLDIVCGAANCRQGLKVACATEGAVLPGDFKIKKTKLRGQPSEGMLCSFSELGIDVEADGIIELPLDAPIGTDLREYLALDDNAIEISLTPNRADCLSIAGIAREIGVVNKQLVNQPHFEAVPATISDKVQIDLQAPEACPRYLLRVIKNVNVKAPSPMWMQEKLRRCGIRSIDPIVDITNYILLEFGQPMHAFDAAKVTQPVQVRFAKEGEELVLLDGSTAKLQSNTLLIADQNGPLAMAGIFGGATSGVNSETKDVILESAFFAPLAIAGRARQYGLHTDASHRFERGVDFELARKAMERATTLLLEICGGEAGEICEASSETHLPKVNTVQLRRSKLDALLGHHIETGSVTEIFHRLGFDVTYANDIWTVTSASWRFDIEIEEDLIEEVARIYGYNSIPNNAPLAHLRMREHKESDLDLARIKTALVDADYQEAITYSFVDPKIQSLLHPHKEALVLPNPISVEMSAMRVSLISGLLGAVLYNQNRQQSRVRLFETGLRFVPDANAEFGVRQEFVLSAVITGTAKSEHWAGKAESVDFFDLKGDLESVLSLTEGGNRVRFVAKQFDALHPGQSAAIELDGQEIGFIGAIHPSISQKLGLNGKTFVFEILWNAIAARNVVQAKEISKFPANRRDLALVVADSVPAGELIAACKQAGGEKLVQVNLFDVYQGVGVAEGYKSLAISLTVQDNEKTLEDEEINAVISAVLAEVKQRFNAELRD

SEQ ID NO: 4017 - protein, 96 aa, H. influenzae strain 86-028NP; identical to SEQ ID NO: 745

SEQ ID NO: 4018 - protein, 161 aa, H. influenzae strain 86-028NP
MKVYKSFLIATASLFLFACSSFQNDDYAMNYKGQIGDPIMAIAMLSEQQHEWAGTPYVLGGVSRRGVDCSGFVQKTFFDRFNLRLPRSTVEQANYGKHVRKEHIQTGDLIFFKTGRGPNGYHVGIYVKEDKFLHASTRGGVVYSSMNNPYWSKAFWQVRRI

SEQ ID NO: 4019 - protein, 336 aa, H. influenzae strain 86-028NP
MLEFSSIFYNDFFQIREIKMPSNLTALQIQLEILRLIPKTRFITAEEILQKLADIGVQRDIRSIQRLLESLSQQFEIERDMRDKPYGYRWKSNAKGLDLPILNEQQSLVLMLAKQYLNGILPSSIMNSMEAFFQQAEYNLVYDSHKKSGAEWLNKVAIAPTSQPLLPAKINPEIFSQISTALYQNRFLQVHYRSIHGKEHKAQVKPLALVQQGPSSYLVAQYENGDILHLALHRLLKVTVSTMIFERPDFNLKSYVESQKFGFTYGRKIRLTFRINKDIGGFLTETPLSMDQTVKDCGTEYEISATVIKSAMLEWWIAHFGEDYQEIDRTYLDENA

SEQ ID NO: 4020 - protein, 151 aa, H. influenzae strain 86-028NP
MKKIVYIDMDNVMVDFPSGIAKLDDKTKREYEGRYDEVEGIFSLMEPMPNAISAVHKLMKKYHIYVLSTAPWHNPSAWSDKVKWIQHYFGEEKGSALYKRLILSHHKNLNQGDYLIDDRTKNGAGKFQGEHVHFGTEQFANKRSLKNDREK

SEQ ID NO: 4021 - protein, 236 aa, H. influenzae strain 86-028NP
MTEKNKPICVVLTGAGISAESGIPTFRSEDGLWAGHKVEEVCTPEALQKNRAKVLDFYNQRRKNAAAAKPNAAHLALVELEKAYDVRIITQNVDDLHERAGSSKVLHLHGELNKARSSFDESYIVDCFGDQKLEDKDPNGHPMRPYIVFFGEMVPMLERAVDIVEQADVVLVIGTSLQVYPANGLVNEAPRKAPIYLIDPNPNTGFVRKQVIAIKEKAGEGVPKVVAELLENTKNS

SEQ ID NO: 4022 - protein, 340 aa, H. influenzae strain 86-028NP
MLVIKENNMNNQNPIEIYQTQDGTTQVEVRFENDTVWLSQAQMAMLFGKDIRTINEHITNIFDDEELEKESTIRKFRIVRQEGKRQVNREIEHYDLDMIISVGYRVKSKQGISFRRWATARLKEYLTQGYTINQKRLQQNAHELEQALALIQKTANSSELTLESGRGLVDIVSRYTHTFLWLQQYDEGLLAEPQTQQGGTLPTYAEAFSALAELKSQLMTKGEASDLFGRERDNGLSAILGNLDQSVFGEPAYPSIEAKAAHLLYFVVKNHPFSDGNKRSGAFLFVDFLHRNGRLFDHNGYPVINDTGLAALTLLVAESDPKQKETLIRLIMHMLKQEKK

SEQ ID NO: 4023 - protein, 66 aa, H. influenzae strain 86-028NP
MAMKVIMARDPLFEDVKKYVQQQKFASCSMIQRRFMLGFNRAGQILEQLEQAGIISSMKNGQRKVL

SEQ ID NO: 4024 - protein, 281 aa, H. influenzae strain 86-028NP
MKNDLNYAVELIRKADGILITAGAGMSVDSGLPDFRSVGGFWNAYPMFKEHNISFEEIATPLAYKHNQELAYWFYGHRLVQYRNTLPHEGYQILKCWAGDKPHGYFVFTSNVDGHFQKAGFNDSHVYEVHGTLERLQCVNNCRGLSWSASSFQPVVDNENLCLTSEKPHCPYCGGFARQNVLMFNDWSYASQYQDFKKVRLESWLKEVQNLVVIELGAGKAIPTVRRFSERTAKAKKGGVIRINPQDAGVPKMHFLSLEMKALDALKAIDRLLNPSQQAVE

SEQ ID NO: 4025 - protein, 253 aa, H. influenzae strain 86-028NP
MENFCEITFCQQIGSNKRRNQDALFNGEAVFQYKLKTAEKRLENRPHFIVGVADGISNSNRPEKASKLAMQLLSQMESINRQTIYDLQSSLSAELAEDYFGSATTFVAAEIDQITRKAKILSVGDSRAYLIDAQGKWQQITQDHSILSELLTDFPDKKEEDFAKIYGGVSSCLVADYSEFQDKIFYQEIEIQQGESLLLCSDGLTDGLSDEMREKIWQKYPDDKYRLTVCRKMIEKQSFSDDLSVVCCHSIIE

SEQ ID NO: 4026 - protein, 324 aa, H. influenzae strain 86-028NP
MFEKIEPTNIRFIKLGIKGCWEKDCIDKNSTASTKNTIRLGYESTSEIHKECLNNQWDSCIEYCKTYWSDHTGTVSNHLRQIQDFYQLGEDTLWITFFGRKLYWAFCSKEVVEESDGSRTRKVISNNGNWSCVDANGKELLVDNLDGRVTKVQAYRGTICGVEMEDYLIRRINGEVIEEITEAKEAYETLIKSVEKLIKGLWWSDFELLTDLVFSKLGWQRYSVLGKTEKGIDLDLYSSSTQKRVFVQIKSDTDIKQLDEYVSNFESEYKNYGYSEMYYVYHSGLENIDEKQYQAKGIKLVNGRKMAELVISAGLVEWLINKRS

SEQ ID NO: 4027 - protein, 55 aa, H. influenzae strain 86-028NP
MSEYKLNPPTVSSYTENMMLKVLFEHKGFSEVFRETSWRSDEIASAFGLPEELRE

SEQ ID NO: 4028 - protein, 571 aa, H. influenzae strain 86-028NP
MHLRSEGAMRDLFGYLPKSDLQRTAAIMADLLKQPKNQILSALKKGSKLDAYGLIDRDYRPDSVHDYLDWGETLDFDEFVTQPLNENVLLKSCTEVAQVPSLQLDDFDHIAGMKEMMLTYLQQALKHHRKGVNLLIYGVPGTGKTEFAGLLAQALGISAYNITYMDSDGDVVEAEQRLNYSRLAQTLLNGKQALLIFDEIEDVFNGSFMERSVAQKNKAWTNQLLENNNVPMIWLSNSVSGIDPAFLRRFDFILEMPDLPLKNKSALITQLTEGKLSPAYVQHFAKVRSLTPAILSRTIRVAKELNTSNFAETLLMMFNQTLKSQNKPKIEPLVLGKADYNLDYVACNDNIHRISEGLKRSKKGRICCYGPPGTGKTAWAAWLAEQLDMPLLLRQGSDLLNPYVGGTEQNIAQAFEQAKADNAILVLDEVDTFLFSREGANRSWERSQVNEMLTQIERFEGLMVVSTNLIEVLDHAALRRFDLKLKFDYLTLKQRLDFAKQQAEILGLPLLSEEDLSQIESLNLLTPGDFAAVARRHQFSPFHKVQDWLMALQGECEVKPAFSATTRRIGF

SEQ ID NO: 4029 - protein, 145 aa, H. influenzae strain 86-028NP
MIIKDPNSDRVNQEDDNLVYLHDLTSTVFDLANQKVPESFEGQSILPIMRQHQDNQRKGVLGQLAGHFVYFEQRMWRRKDYKLVFNATDVCELYNIRNDPEEMHNLFYDPQYNRIKKEMLEEIRAEMKRLNDPLENWVYRIIDEI

SEQ ID NO: 4030 - protein, 270 aa, H. influenzae strain 86-028NP
MKTTLLKTLTPELHLVQHNDIPILYLKHAVGTAKISLQGAQLISWKPQNAKQDVLWLSEVEPFKNGNAIRGGVPICYPWFGGVKQPAHGTARIRLWQLSHYDISAHKVRLEFELFSDLNIIEAKIAMVFTDKCHLTFTHYGEESAQAALHTYFNIGDINQVEVQGLPETCFNSLNQQQENVPSPRHISENVDCVYSAENMQNQILDKSFNRTIALHHHNASQFVLWNPWHKKTSGMSETGYQTMLCLETARIHHLLEFGESLSVEISLKG

SEQ ID NO: 4031 - protein, 135 aa, H. influenzae strain 86-028NP
MAEQAELDLVEISPNAEPPVCRIMNYGKFLYEKSKTAKEQKKKQKVVQVKEIKFRPGTDEGDYQVKLRSLIRFLEDGDKAKITVRFRGREMAHQDIGLDVLERVKNDLAEISVVESAPGKLEGRQAVMVLAPKKK

SEQ ID NO: 4032 - protein, 89 aa, H. influenzae strain 86-028NP
VLPSNFISSPDYVVLNEKCGVILTMPKIKTVRGAAKRFKKTASGGFKRKQSHLRHILTKKTTKRKRHLRHKSMVAKADQVLVVACLPYA

SEQ ID NO: 4033 - protein, 117 aa, H. influenzae strain 86-028NP
MARVKRGVIARARHKKVLKAAKGYYGARSRVYRVAFQAVIKAGQYAYRDRRQRKRQFRQLWIARINAAARQNGLSYSKFINGLKKASVEIDRKILADIAVFDKVAFAALVEKAKSAL

SEQ ID NO: 4034 - protein, 1211 aa, H. influenzae strain 86-028NP
MAETIPLNPITLPLNQISLIEASAGTGKTYTIGSLYLRLLLKAGENNFSRPLNVEEILVVTFTEMATEELKKKIRERITDAINKLTAFAKTQDKSAFKNDEFLTALCDNLDIFEAIHRLKLAEQNMDLAAIYTIHGFCRRMLMQYAFHSGIHFNLELIKDQSDLLVRFANEFWREHFYPLDFESANFIATELVSPAKVLSLLKADLGKDLQVEIENKQALSVPIQIFLPQYLGGYQKALNELKAFWLESADEILAIITNELEKDYPKDQLKSLNRKKYQVKRLGDWINKINQWSNNPRDYQINTTLKDYFLQSSIEKNCEESTDKNKDKKPATPFYSPIFAELEKRVNALMTPDLLSKLTLYHYRQGLQQKLLDYKLNHQEKSFDDLLRLLCEALQDAQGDELAEMIRFQYPFAMIDEFQDTDSQQYAIFSKIYRDNPEKNTGFIMIGDPKQAIYRFRGADIFTYLKASDEAQSRFELTKNYRSEKHLVDGVNALFDFPQSPFIYQNIKFTAVDSRDDHLRFYLNGKAEPAYRFYLTESDKVNKTEMAKICAISIQHWLKSAAENQAVFQNEDTRKTLQAANIAVLVRDKNEAALVKNELQKLGIASVYLSDQNSVFDSNVAKELAWVLKACLNVAERPILNAIATALFGLNAADIHQIQQNEADWQRWADSFAQYQQTWQRQGILAMLHQILLEQGISERLLSQATGERDLTDFLHLAEILQQAATLHESESALLSWFEKQIQGEGRQEAQIRLESERQLVKIVTIHKSKGLEYDLVWLPFLAVPSKDPSKKDINIYYSKERDETLWDIENRNLNALCEETFAEELRLLYVALTRAKYQMAFALPAQFDKKWNALHYVLSQGEIGKEINLSNSKDTETLLQAFKEKMRDNVEICTKPNLEAFPALSINTKNDELKAAEFTGNIEQDWRITSFTSIEQGHRRQNYFAESAEKKHAVFDDAKDYDSQNAIEISTALLNENESNILDLPRGKQVGTALHRHFENCYFSDLANIEEIDKLRQSLQLDETFTEPLQNWLQQISHTPLSHEIGIALADLANKDCIKEMPFYLAIWEHFDVEEFNRTLKAHHHLPSEPLQFEQIQGMVRGSIDLVFRHNGKYYLIDYKSNFLGSTLADYNQEALKKEMLHSHYDWQYLIYTLALHRYLQSVVPHYDYARDFGGVFYLFLRGMNGEPQSGVFYDRPSVELITELDGVF

SEQ ID NO: 4035 - protein, 640 aa, H. influenzae strain 86-028NP
MLSVLHKLKEQRILSQGDYYFAKLIADKQCHTDYAEPIKNLAILLAALCSWRYTQGNTCSQLDRYLEHNLFGLAYRTTEEDYLAEIREKIGYLAVEDWQNALCGHMAFTQDPVNQIAPMVFQFGALYFYRTWQDEYRIAQYIKNTLKKHRTLAFSYDEIHQKLEKYFPEKQEKTDWQKVAVATAIKSPFSIITGGPGTGKTTTVTRLLLVLQELFDCKLHIKLVAPTGKAASRLEESIKNALGFMQEKMNVSHSLFNAIPQKASTLHSLLGVNAFNDYTRYNSHNPLQLDVLVVDETSMIDLPMMVKLINALKPETRLILLGDQAQLASVEAGAVLGELAQFVTQPYSHEQVAYLLATTGYKVEGSDCSNPIRDCLCHLTESRRFDKDSGIGKLAEFIQKGKADDSLELFDHYPQELHFNALNDESDAVNQVVKSAVENYRTFLKMLDDLRKQKIDPNAKNEQGISYAEAIQAQFNSVRFLTALRNNNLGVENLNKEIALALREQKLLWFRNEQDWYIGKPIMITENDHNVRLYNGDIGLCLANGKVWFGNREVLTNRIPAHEPAFMMTIHKSQGSEFEHTVMVLPTEVNPVLSRELVFTGVTRAKKELTVFADEKIWKTAIRQTVKRQSGLGKLLEDLN

SEQ ID NO: 4036 - protein, 148 aa, H. influenzae strain 86-028NP
MKYQKLENQESNWKWIYLIRKHREGENITRYEERSLQEAKAQELLESQNYPSQIEEWIKNHLSPALPIKLDQAIRARRKRFFNGEKQHTKKKSIDLEYAVWLRLSKYSRKMKMTLSETITYMIDERESKAQFENQMAAMKTSLKNLLK

SEQ ID NO: 4037 - protein, 601 aa, H. influenzae strain 86-028NP
VVNFSRKRPAVSSLFSQQQAIEQSLNWQALQPDLVIQDFPLEPVDFWALQPNATQGIDLFLRHPTRSLLMMKVGEPVEYAELLQNFISQNHHKVRSIFGVNYVIEQGDSFSFPHVYTEPAKSLDDNFASQGEALSALYCDQFQLFGSFRIHPSSQDIQLVPGLVHKANGGVLILSAATLLSQFDLWGRLKQILQTQTFDWYSAHPFKNLPCDIPSYALNLKVIVLGNRTELATLAELEENLYSFADYAEIESYISVAEVEEQKTWASYVQQMAQEQNIELDFLALNKLYQLLVRESENRFLINASPLKLKEILQDASTFAEKTALSAVDFEGIFQQKLAQYGFLKEQTYADILNEQVYVETQGEIVGQINGLSVIEYPGTPVCFGEPSRISCIVQFGDGEVIDVERKNELAGNIHGKGMMIAQACLSNILDLPSQLPFSASLVFEQSYGEIDGDSASLAIFCVLASALADLPLPQHIAITGSIDQFGLVHSVGGVNDKIEGFFTICQRRGLTGKQGVIIPMTTIQQLSLSNEVKSAVKNGEFFIYPVEDIYQACELLFGRDLLDENKDYTEKTEPLSRLIQRRIEGRADSERKSFWHFFRS

SEQ ID NO: 4038 - protein, 177 aa, H. influenzae strain 86-028NP
MQNTCTLNKKNSYSYDDLLASGRGELFGKEGPQLPAPTMLMMDRIVEMNEETGTFGKGYIEAELDIKPELPFFGCHFIGDPVMPGCLGLDAMWQLVGFYLGWIGGKGKGRALGVGEVKFTGQILPTAKKVVYRIHMKRVINRKLVMGMADGEVEVDGRVIYTATDLKVGLFQDTSAF

SEQ ID NO: 4039 - protein, 242 aa, H. influenzae strain 86-028NP
MMANDDFQEYVKQLVTKHRDERIYPFQYEGKKYWLKQPEKLKGIWLLLKPHPKKSFKNELHTLLKLAEQNAPVPKVSYYSDHFFVLENVGLTVSQWLCNKNIDEQQKFLIIYDACLALIDLHAKNLIHGRPAIRDITWDKGKVTFLDFESRANSQNQNWVVIRDMLFFFDSLCREEDISDDFIQKVALYYQAYCRVENWQNMIVFLQRFRWVYYLLLPFKPFAKKDLIAVYRLFEILLIKKK

SEQ ID NO: 4040 - protein, 45 aa, H. influenzae strain 86-028NP
MMKKIFFIFVLSGILAACAMGGGIRAGGGSNGVGLGVGIGSGIRF

SEQ ID NO: 4041 - protein, 89 aa, H. influenzae strain 86-028NP
MSLSTEKKAAIVAEFGRDAKDTGSSEVQIALLTAQINHLQAHFAEHKKDHHGRRGLLRMVSRRRKLLDYLKRTDLALYQSTIARLGLRR

SEQ ID NO: 4042 - protein, 123 aa, H. influenzae strain 86-028NP
MKCKVYTVVVPNVQSATLLPIIRKKVKPDSIVYTDTFRSYDMLDVSEFSHFRINHSTHFAENHNYINGIGNFWNHAKRHLQKFNGIPKEHFELYLKECEWRFNNSEIKSQISILKQLVKGSLV

SEQ ID NO: 4043 - protein, 38 aa, H. influenzae strain 86-028NP
LEMFEGKIEADESYFGSTRKGKRGRSVAGKVAVFGLLK

SEQ ID NO: 4044 - protein, 479 aa, H. influenzae strain 86-028NP
MKKLSSISTALGSFLLSVSFSLPTFANINVSDLTQKLPEGSNAGVIAKNINQNQIIADYNGSTFMLPASTQKVFTAVAAKLALGDQFQFETALLSNGKIQNGNLDGNLIVSFTGDPDLTRGQLYSLLAELKKQGIKKINGDLVLDTSVFSSHDRGLGWIWNDLTMCFNSPPAAANIDNNCFYAELDANKNPGEIVKINVPAQFPIQVFGQVYVADSNEAPYCQLDVVVHDNNRYQVKGCLARQYKPFGLSFAVQNTDAYAAAIIQRQLRKLGIEFNGKVLLPQKPQQGQLLAKHLSKPLPDLLKKMMKKSDNQIADSLFRAVAFNYYKRPASFQLGTLAVKSILQKQGIRFGNSILADGSGLSRHNLVAPKTMLSVLEYIAKNEDKLHLMETFPIAGVDGTISGRGGLISPPLVKNVIAKTGSLKGVYNLAGFMTNARGEKVAFVQFINGYSTGDLESKTKRAPLVQFERNLYNELYKY

SEQ ID NO: 4045 - protein, 158 aa, H. influenzae strain 86-028NP
MQQIPMTVRGAEQLREELDFLKNVRRPEIIKAIAEAREHGDLKENAEYHAAREQQGFCEGRIQEIEGKLGNAQIIDVTKMPNNGKVIFGATVVLVNTNTDEEVTYRIVGDDEADIKSGLISVNSPIARGLIGKELDDTVNITTPGGVVEFDIIEVNYI

SEQ ID NO: 4046 - protein, 99 aa, H. influenzae strain 86-028NP
MTTLSTKQKQFLKGLAHHLNPVVMLGGNGLTEGVLAEIENALNHHELIKVKVAGADRETKQLIINAIVRETKAAQVQTIGHILVLYRPSEEAKIQLPRK

SEQ ID NO: 4047 - protein, 209 aa, H. influenzae strain 86-028NP
MGKKKRSASSSRWLNEHFSDQFVQKAHKQKLRSRAYFKIDEIQQTDKLFKQGMTVVDLGAAPGGWSQYVVSQIGGKGRVIACDILEMDPIVGVDFLQGDFRDENVLNALLERVGEAKVDVVMSDMAPNFSGMPSVDIPRAMYLVELALDMCKQVLASKGSFVVKVFQGEGFDEYLREIRSLFNVVKVRKPEASRGRSREVYIVATGYKG

SEQ ID NO: 4048 - protein, 635 aa, H. influenzae strain 86-028NP
MVKNLVLWVVVAVIMMTAYQSFNSSSVENSTDYTTFVYDVSNGQVTAARFDANEITVTKTDGSKYSTVMPPLEDKKLLDDLLSKKVKVEGTPFERRGFLSQILISWFPMLFLVGVWVFFMRQMQGGGGKAMSFGKSRAKMLNQDQIKVTFADVAGCDEAKEEVGEIVDFLRDPNKFQNLGGKIPKGILMVGPPGTGKTLLARAIAGEAKVPFFTISGSDFVEMFVGVGASRVRDMFEQAKKNAPCLIFIDEIDAVGRQRGAGLGGGHDEREQTLNQMLVEMDGFSGNDGVIVIAATNRPDVLDPALTRPGRFDRQVVVGLPDVKGREQILKVHMRKVSVAQDVDAMTLARGTPGYSGADLANLVNEAALFAARVNKRTVTMLEFEKAKDKINMGPERRTMIMTDKQKESTAYHEAGHAIVGYLVPEHDPVHKVTIIPRGRALGVTFFLPEGDQISISQKQLESKLSTLYAGRLAEDLIYGEENISTGASNDIKVATNIARNMVTQWGFSEKLGPILYTEDEGEVFLGRSMAKAKHMSDETAHAIDEEVRAIVNRNYARAREILIDNMDILHAMKDALVKYETIEEEQIKQLMNREPVTPPSGWGEPKTQQAAYANSTTNDTKPESAVENTDNFNV

SEQ ID NO: 4049 - protein, 276 aa, H. influenzae strain 86-028NP
MKLYANNKCLDLSVPKIMGILNFTPDSFSDSGQFFSLDKALFQVEKMLEEGATIIDIGGESTRPNDADEVSEQEELHRVVPVVEAVRSRFDCWISVDSSKAVVMREAASVGMDLINDIRALQEPNALETAVKLALPVCIMHMQGQPRTMQANPHYENVVQDVFAFLQKRTNECLSAGVKKENLIWDMGFCFGKSVQHNYQLLQNLNEFCHSGYPVLAGLSRKSMIGAVLDKPVDQRVIGSAAGALIAAQKGAKILRVHDVAATSDMLKVWQATENA

SEQ ID NO: 4050 - protein, 445 aa, H. influenzae strain 86-028NP
MANRKYFGTDGVRGKVGSYPITPDFALKLGWAAGKVLASQGSKMVLIGKDTRISGYMLESALEAGLAAAGLSAAFTGPMPTPAIAYLTRTFRAEAGIVISASHNPYYDNGIKFFSAKGTKLPDEIEEAIEAMLEQPMDCVESAELGKASRINDAAGRYIEFCKGTFPAHLGLEGYKIVVDCANGATYHIAPNVLRELGAEVIEIGTDPNGLNINEKCGATDVTALQAKVVETKADVGLAYDGDGDRIMMVDHLGNKVDGDQILFIIAREALRSGQLKGGVVGTLMSNMSLEIALKMLGVPFLRANVGDRYVLEKMLENDWTLGGENSGHIIIADKNTTGDGIVASLAVLAAMAQHKLSLNELASAVKLFPQVLINVRFAGGENPLESDAVKSVAAEVEKRLEGKGRILLRKSGTEPLIRVMVECQDAELAQQCAEEIAEAVKKIN

SEQ ID NO: 4051 - protein, 164 aa, H. influenzae strain 86-028NP
MNIFIMRHGESEVMANSDKARRLTAYGIKQAFSQGEWLKQHLSTLVINSLDRILVSPYVRAQETFHQVNQAFDLELENKFEIWEGITPYGHAHSVIDYLEVLKDEGVKSVLIVSHLPLVGEIVAELYGKRNPISFYPATIAQLLWDGNKSEILMHQASPVIYLK

SEQ ID NO: 4052 - protein, 191 aa, H. influenzae strain 86-028NP
MEKIMKKLTLALVLGSALAVTGCFDKQEAKQKVEDTKQTVASVASETKDAAANTMTEVKEKAQQLSTDVKNKVAEKVEDAKEVIKSATETASEKATEIKEAVSEKASEMKEAASEKASEMKEAASEKASEMKEAASEKASEMKEAASEKASEMKEAASEKVGEMKEKATEMKEAVSEKATQAVDAVKEATK

SEQ ID NO: 4053 - protein, 454 aa, H. influenzae strain 86-028NP; identical to SEQ ID NO: 662

SEQ ID NO: 4054 - protein, 46 aa, H. influenzae strain 86-028NP
MFYYNSASKQASKQASKQASKQASNANLFFSSVKPTMTASLISTVC

SEQ ID NO: 4055 - protein, 50 aa, H. influenzae strain 86-028NP
LLISSQAFAASDNSISTNYGIKEFGAYSLIIGNLKNNTINSKISNQALTS

SEQ ID NO: 4056 - protein, 198 aa, H. influenzae strain 86-028NP
MLKEVGFISYISFKGIKMNVISDLELQQIRTQMLTFAQLQVNQADLAEDLVQEAFLSAFKNLDNFKHQSAFKTWIFAILKNKIIDYLRQKGRFVLESELEDEDTNNSFFDEKGHWKPEYYPSELQGEEETVYSDEFWLIFETCLTCLPAKQAKVFMMREFLDLSSEEICQETHLTSSNLHTTLYRARLQLQNCLSKKL

SEQ ID NO: 4057 - protein, 57 aa, H. influenzae strain 86-028NP
MRCRQATRMISESHERSLDIQEKVGLKVHLAMCSRCRRFQRNCKTLSMMMKKFKDSH

SEQ ID NO: 4058 - protein, 300 aa, H. influenzae strain 86-028NP
MPNLPLFSKVKIYMQSHSIPSLYHKAISFMVSAYFSITLMNVFVKTASQTIPASETLFSRFLIGLLFLLPFVIKDRDFKVDTRQWKFLILRNAAGVSNMLINFYVVKFLPLSIAVLLMNTSALFIPILLLFFHQKTPLNVLLCSLIGFLGVSIILLTNHNGNVDPIYVLIGLSGAVLAGMAFIGLQELNKYNTPKNIVFYFHLIGTFMLPVFFINQWKIPNLYELGLLLLVGGFGLIFQLLLTRAFKYAPANIITPFAFTGVVFSSVFDWLFWHHTPNLYFWLGAVIIVGAVSLLAKLKK

SEQ ID NO: 4059 - protein, 353 aa, H. influenzae strain 86-028NP
MKLSKTFLFITALCSATPTLAIQNSTSSSGEQKMAMENTQNIREIYLAGGCFWGMEAYMERIHGVKDAISGYANGNTGKTSYHMIGLTDHAETVKVTYDANQISLDKLLKYYFKVIDPTSVNKQGNDRGRQYRTGIYYQDGADKAVIEQALAQLQTKYKKPVQVEVQPIKNYIVAEEYHQDYLKKNPNGYCHIDITKADEPVIDEKDYPKPSDAELKAKLTPLQYSVTQNKHTERSFSNEYWDNFQPGIYVDVTTGEPVFSSNDKFESGCGWPSFTKPIIKDVVHYETDNSFNMQRTEVLSRAGNAHLGHVFDDGPKDKGGLRYCINSASIKFIPLAEMEKAGYGYLIQSIKK

SEQ ID NO: 4060 - protein, 213 aa, H. influenzae strain 86-028NP
MLDQQLLIGTVFLAGLASFLSPCIFPIIPIYFGILSKGGKKVLNTFLFILGLSLTFVSLGFSFGFLGNILFSNTTRIIAGVIVIILGIHQLGIFKIGLLERTKLVEIKTSGKSTALEAFVLGLTFSLGWTPCIGPILASVLALSGDEGSALYGASMMFVYVLGLATPFVLFSFLSDSLLKRAKGLNKHLDKFKIGGGILIIVMGILLITNNFS

SEQ ID NO: 4061 - protein, 156 aa, H. influenzae strain 86-028NP
MKKLLSIFLMAFSLNAFAQTNLADVQLKDLNNQPVTLSQYKGKPVYVKMWASWCPICLAGLAEIDDLSAEKDRNFEVITIVSPDHKGEKDTADFIEWYKGLEYKNITVLLDEKGEIIDKARVRGYPFNLFLDSDLNLKKTVPGHLGAEQIKVFAGK

SEQ ID NO: 4062 - protein, 107 aa, H. influenzae strain 86-028NP
MTTEIKKLDPDTAIDIAYDIFLEMAGENLDPAYILLFNLQFEERGGVEFVETADDWEEEIGVLIDPEEYAEVWVGLVNKQDEMDDVFAKFLISHREEDREFHVIWKK

SEQ ID NO: 4063 - protein, 243 aa, H. influenzae strain 86-028NP
MIELSHEEELRYNRQIILKSVDFDGQEKLKASKMLIVGLGGLGCAASQYLAAAGVGNLTLLDFDTVSLSNLQRQVLHCDTRLNMPKVESAKIALEQINPHINIETINAKLDEEKLAEIIPHFDIVLDCTDNVEIRNQLDRQCNHAKIPLISGAAIRMEGQVSVFTYEPNTPTYRDLSKLFGQNVLSCVEAGVLAPIVGIVGCIQALEAIKVRLKIGKNLCGRLLMIDGFSMNIREIKLPTNME

SEQ ID NO: 4064 - protein, 404 aa, H. influenzae strain 86-028NP
MLTLDQARSKMLEQLPFPTQTEYLNLQEAANRICAEDIISPINVPSFDNSAMDGYAVRLSDLQQSLTLSVAGKSFAGNPFKEEWPSKSAVRIMTGAMIPEGTDAVIMQEQVTLNEDGTITFSELPKPNQNIRRIGEDVKKGDVVLEQGAPLTPVSLPLLASLGIAEVKCYRQLKVGVLSTGDELVEVGKPLQSGQIYDTNRFTVKLLLEKLNCEVIDLGLLPDNEAEFEKAFIAAQSQADLVITSGGVSVGEADFTKAVLEKVGKVNFWKIAIKPGKPFAFGKLENAWFCGLPGNPVSALVTFYQLVQPLIAKLQGQKQWKNPPHFSAIATMNLKKAVGRLDFQRGFYYINEQGQIEVQSVGFQGSHLFSAFVKSNCFIVLEQERGNVSAGETVTIEPFNHLLG

SEQ ID NO: 4065 - protein, 218 aa, H. influenzae strain 86-028NP
MSKISLDALNVRNALIEKGIETPMIDPTQAKDERRESIAKHMHEVMKLIGLDLRDDSLEETPNRLAKMFIDEIFSGMDYANFPKMTKIKNQMKVSEMVQVNDITLTSTCEHHFVTIDGKVCVAYYPKDWVIGLSKINRIVSFFAQRPQVQERLTEQLLTAFQTILETDDVAVYVKATHFCVKARGIRDTNSYTVTSAYGGVFLEDRDTRKEFLATVQK

SEQ ID NO: 4066 - protein, 107 aa, H. influenzae strain 86-028NP
MINCNPHVKCADFYFGKLNMLCAIYKSKKKLGSYLYVANREDFSLVPSVLLEHFGKPELVMMFNLLGRKALYNVDCNEVLETIKRQGFYLQIAKQDDGLFNSLSEIK

SEQ ID NO: 4067 - protein, 242 aa, H. influenzae strain 86-028NP
MSSFFVAGTDTNVGKTTAARAMIQALQEQGVQVVGYKPIACCGEESIYPIAQSENTSDYDHFVNADVLTLMHSTKENVSYQDINSYTFSHCAPMLTQDKMRIKLDKINYDLTHLNQTYQSVVVEGSFGLMTPMAEGKSFADWITQRKMPVVLVVGIKDGCVNHALLTVKVIQQLGVPLLGWIANRINPLLSHYAEIVDLLVEHIDAPLLGKIPYLHKPEEQELGHYLTNIDRLMYMQTEFIK

SEQ ID NO: 4068 - protein, 292 aa, H. influenzae strain 86-028NP
MSYAKEIDTLNQHIADFNKKINVSFEFFPPKNEKMETLLWDSIHRLKVLKPKFVSVTYGANSGERDRTHGIVKAIKQETGLEAAPHLTGIDATPEELKQIARDYWDSGIRRIVALRGDEPKGYAKKPFYASDLVELLRSVADFDISVAAYPEVHPEAKSAQADLINLKRKIDSGANHVIIQFFFDIENYLRFRDRCASIGIDTEIVPGILPVTNFKQLQKMASFTNVKIPAWLVKAYDGLDDDPTTRNLVAASVAMDMVKILSREGVNDFHFYTLNRSELTYAICHMLGVRP

SEQ ID NO: 4069 - protein, 142 aa, H. influenzae strain 86-028NP
MKTFVAKPETVKRDWYVVDATGKTLGRLATELARRLRGKHKAEYTPHVDTGDYIIVINADKVAVTGRKETDKLYYWHTGYVGGIKQATFKEMIARRPEAVIEIAVKGMLPKGPLGRAMFRKLKVYAGAEHQHAAQQPQVLDI

SEQ ID NO: 4070 - protein, 130 aa, H. influenzae strain 86-028NP
MAENQNYGTGRRKSSSARVFIKPGSGKITINQRELDVYFGRETARMVVRQPLELVELTDKLDLYITVKGGGISGQAGAIRHGITRALMEYDETLRPALRAAGFVTRDARRVERKKVGLHKARRRPQYSKR

SEQ ID NO: 4071 - protein, 212 aa, H. influenzae strain 86-028NP
MSSTSSKRSVMTLFSNKDDIYCHQVKIVLAEKGVLYENAEVDLQALPEDLMELNPYGTVPTLVDRDLVLFNSRIIMEYLDERFPHPPLMQVYPVSRAKDRLLMLRIEQDWYPTLAKAENGTEKEKTSALKQLKEELLGIAPIFQQMPYFMNEEFGLVDCYVAPLLWKLKHLGVEFTGTGSKAIKAYMERVFTRDSFLQSVGEAAPKNLMDDK

SEQ ID NO: 4072 - protein, 150 aa, H. influenzae strain 86-028NP
MEYKSSPKRPYLLRAYYDWLVDNSFTPYLVVDATYLGVNVPVEYVKDGQIVLNLSASATGNLQLTNDFIQFNARFKGVSRELYIPMGAALAIYARENGDGVMFEPEEIYDELNIEPDTEQPTGFYEAVDKPKKREEKKKTKSVSHLRIVD

SEQ ID NO: 4073 - protein, 625 aa, H. influenzae strain 86-028NP
MTNNMNNYPLLSLINSPEDLRLLNKDQLPQLCQELRAYLLESVSQTSGHLASGLGTVELTVALHYVYKTPFDQLIWDVGHQAYPHKILTGRREQMSTIRQKDGIHPFPWREESEFDVLSVGHSSTSISAGLGIAVAAERENAGRKTVCVIGDGAITAGMAFEALNHAGALHTDMLVILNDNEMSISENVGALNNHLARIFSGSLYSTLRDGSKKILDKVPPIKNFMKKTEEHMKGVMFSPESTLFEELGFNYIGPVDGHNIDELVAMLTNMRNLKGPQFLHIKTKKGKGYAPAEKDPIGFHGVPKFDPISGELPKNNSKPTYSKIFGDWLCEMAEKDAKIIGITPAMREGSGMVEFSQRFPKQYFDVAIAEQHTVTFATGLAIGGYKPVVAIYSTFLQRAYDQLIHDVAIQNLPVLFAIDRAGIVGADGATHQGAFDISFMRCIPNMIIMTPSDENECRQMLYTGYQCGKPAAVRYPRGNAVGVKLTPLEMLPIGKSRLIRKGQKIAILNFGTLLPSALELSEKLNATVVDMRFVKPIDIEMINVLAQTHDYLVTLEENAIQGGAGSAVAEVLNSSGKSTALLQLGLPDYFIPQATRQEALADLGLDTKGIEEKILNFIAKQGNL

SEQ ID NO: 4074 - protein, 296 aa, H. influenzae strain 86-028NP
MGHFSEELQQVQTRINRFLEAQFEGIESHNALLLEAMKYALLLGGKRVRPFLVYATGQMLGAEKQTLDYAAAAIEAIHAYSLIHDDLPAMDDDNLRRGHPTCHIQFDEATAILAGDALQSFAFEILTKTPNISAEQKLALIQILAQGAGVQGMCLGQSLDLISEHKQISLSELELIHRNKTGALLIAALKLGFICSPHFTDKRLEQSLTQYAEAIGLAFQVQDDILDIEGDSAEIGKQVGADLDLDKSTYPKLLGLSGAKQKAQDLYQSALSELEKIPFDTTALRALAEFVITRKS

SEQ ID NO: 4075 - protein, 84 aa, H. influenzae strain 86-028NP
MARKPASSQDFETTLAQLENIVTHLENGDLPLEEALKEFEQGVQLAKLGQERLQQAEQRIQILLQKTEDAPLNDYKGNDYEGNA

SEQ ID NO: 4076 - protein, 485 aa, H. influenzae strain 86-028NP
MKFIVKLFPEIMIKSETVRKRFAKILTSNIRNILQKYDEETAVVRHWDYIEVRSKNEENREELIALLQRIPGIHHFLEVEEKPFTDLHHIFELTLADVAQQLQGKTFCVRVKRKGKHKFSSIEAERYIGGGLNQHIESAKVRLKNPDVTVRIDIEDDKMMLVKTRHAGIGGYPIGTQEDVLSLISGGFDSGVSSYMLIRRGSRVHYCFFNLGGAAHEIGVKQMAYHIWQRYSASHKVRFITINFEGVVGEILEKVDNGQMGVVLKRMMVRAASKVAQRFNIEAIVTGEALGQVSSQTLTNLRLIDEAADALVLRPLITHDKEQIIAMAKEIGTDDIAKSMPEFCGVISKNPTIKAVREKILEEEGHFNFEILESSVQNAKYLDIRQIAEETEKEVVEVEAISVLGENEVILDIRSPEETDEKPFESGTHDVIQMPFYKLSSQFGSLDQSKNYVLYCERGVMSKLQALYLKENGFSNVRVFAKNIH

SEQ ID NO: 4077 - protein, 106 aa, H. influenzae strain 86-028NP
MRNQTKQHLEQLQITMQQLNLWQTMPPAAEAFLSEEPFSIDTMSAEEWLQWVFIPRMQALLESGSALPHKIAISPYIEEAMKEFDELQQLLTPLVALEELLNNNQC

SEQ ID NO: 4078 - protein, 239 aa, H. influenzae strain 86-028NP
MLEILYQDEFLVAVNKPDGMLVHRSWLDPHETQFVMQTLRDQIGQHVFPIHRLDRPTSGVLLFALSSEIANLMCEQFEQKCVQKSYLAVVRGYLQGKERIDYPLKIQLDKIADKFSQEDKEPQEAVTDYEGLKIVEMPYPAGRYQTARYSLVKLIPHTGRKHQLRRHMKHIFHPILGDTQYGDLHQNRALMSHLGCSRLFLHSNSLSFIHPITKEQITITAGLDEQWHQLINQFGWENV

SEQ ID NO: 4079 - protein, 52 aa, H. influenzae strain 86-028NP
MFDINLTHEQQQKAVEQIQELMAKGISSGEAIQIVAKALREIHKNDKKTPDN

SEQ ID NO: 4080 - protein, 72 aa, H. influenzae strain 86-028NP; identical to SEQ ID NO: 650

SEQ ID NO: 4081 - protein, 158 aa, H. influenzae strain 86-028NP
MTPAIDLLKKQKIPFILHTYDHDPNNQHFGDEAAEKLGIDPNRSFKTLLVAENGDQKKLACFVLATANMLNLKKAAKSIGVKKVEMADKDAAQKSTGYLVGGISPLGQKKRVKTVINSTALEFETIYVSGGKRGLSVEIAPQDLAKVLGAEFTDIVDE

SEQ ID NO: 4082 - protein, 317 aa, H. influenzae strain 86-028NP
MDATLNIAIAAEFELSEKIVERLEQSTLEISKVSIVEIIPFEEEQNIRFRNKGVEQLAPNEVEWADFNYVFFAGKLEQVAHIAQAAEQGCIVIDMLGVCSALSDVPVVVPTVNESQLLELRQRNIVSLPDPQVSQLALTLAPILQETNLNQVFVTSLLPTSYTDAETVTKLAGQTARLLNGIPLDEEETRLAFDVYPHQAPNLSNQLQRIFPQLDRATFHSIQVPVFYGLAQKVTALSDYDFDYQPQNSELVALEETLITPVLNGEQENGEESVKLHLSQISAVENGVEFWSVADEQRFNLALLSVKLLEGIYQQGY

SEQ ID NO: 4083 - protein, 268 aa, H. influenzae strain 86-028NP
MSRFETQFATLNAKNEGAFVPFVTLCDPTFDCSFEIICTLVDNGADALELGFPFSDPLLDGPVIQAANNRALTAGHSSEDSFKLLEKVRSKYPEIPISLLLCANLIFAKGLDAFYQRCAEVGVDAVLVADIPLLAKEDYVQAAKKHGIQPVFICPPNADEKTIQGVAKNSEGYTYLVSRAGVTSAENQAHAANLDTLVEQLKAHYAPPILQGFGIAQPAQVKEALALGAAGAISGSATVKIIERNLDNHEQCLAELAEFVQTMKAATK

SEQ ID NO: 4084 - protein, 397 aa, H. influenzae strain 86-028NP
MSDTLLNPYFGEFGGMYVPEILVPVLKQLEQAFVEAQNDPTFQAEFADLLKNYAGRPTALTLCRNLTKCTKTKLYLKREDLLHGGAHKTNQVLGQILLAKRMGKTRIIAETGAGQHGVATALACAMLDMPCRVYMGAKDVERQSPNVFRMRLMGAEVIPVEKGSCSLKDACCEAMRDWSANYETTHYLLGTAAGPHPFPTIVREFQKMIGEETKRQILEREGRLPDAVIAAVGGGSNAIGMFTDFIDEPNVRLIGVEPAGKGIESGEHGAPLGHAKVGIYFGMKSPLMQTEDGQVEESYSVSAGLDFPSVGPQHAYLNEIGRADYVSITDEEALNAFQELAKHEGIIPALESSHALAYALKLIKQNPEKEQLLVVNLSGRGDKDIFTVDKILNGGTN

SEQ ID NO: 4085 - protein, 252 aa, H. influenzae strain 86-028NP
MRTTTALVTGATAGFGLAICKKLIEAGYKVIGTGRRADRLAEIHSQLGNNFLPLAFDIRDEQVTINALNTLPEGWQAVDLLVNNAGLALGLEPAHKADLQDWYQMIDTNIKGLVTITRLVLPNMVARNHGQIINLSSIAGTYPYAGSNVYGGTKAFVTQFSLNLRADLAGTKIRVSNVEPGLCGGTEFSNVRFHGDDERAAKVYENVQSVQPEDIANIVLWLHQQPEHVNINRIEVMPTAQSFAGMSVSKEK

SEQ ID NO: 4086 - protein, 344 aa, H. influenzae strain 86-028NP
VSNTQLSYKDAGVDIHTGNELVERIKGDVKRTRRSEVMGGLGGFGALCALPTKYKEPILVSGTDGVGTKLRLAIDLKKHDTIGQDLVAMCVNDLIVQGAEPLFFLDYYATGKLDVDVAASVIKGIADGCEMSGCALVGGETTEMPGMYHEGDYDLAGFCVGVVEKSEIIDGTAVKTGDTLIALGSSGAHSNGYSLIRKVLEVSGANPADLLEGKPLSEHFLAPTKIYVKSILQLIKQTEVHAIAHLTGGGFWENIPRVLPANTKAVIDESSWQWPAIFNWLQEKGNISRYEMYRTFNCGVGMVISLPEKEVETALALLEQAGEKAWVIGKIEHLGEGEAQVEIQ

SEQ ID NO: 4087 - protein, 212 aa, H. influenzae strain 86-028NP
MKKIAVLISGQGTNLQTIIDACHLGDIPAKIACVVSNKADAYGLVRAKQAQIPQAVFLRKNFSNNLEMDDAIGDYLQSLAVDLIVLAGYMKILTPKFTQRFAGKILNIHPSLLPKYAGLNTYQRAIEAGDNEHGTTVHFVNEEVDGGAIVLQAKVPIFPEDSIEEVEAKTREQEYQIYPLVIKWFTEGRLRLKDNLAYLDGKALPKSGYANE

SEQ ID NO: 4088 - protein, 278 aa, H. influenzae strain 86-028NP
MKKTLITGLLVLAGTAQAHEVWVQAPTKLTSGSVLKAELAYGDYPYVEKIPEARLKIFAPMEIIRQDGEKQTLIQKGENYQYQSEKALSDGSYWVTATYKPTFWSQNAEGWKMDNLKELENPTYCEQTQMFGKSLVTVGKKPLNAEMAMTRVGLPLEIVPLRDPSKAKSGEPFPVQIFYQDQPLAGETVIATADTIIVKDLEASTGHREPQGFSGKTDSQGRVNIIPLIDGIWKIKVIHKTPFADQQICQQSASYSTLILPVGKGLAKLPPKPEHHHH

SEQ ID NO: 4089 - protein, 340 aa, H. influenzae strain 86-028NP
VLDKNKFIQINLVPCHFCYSFLSYASILEAIMKFKNILVVLNPSNEKQYALARAVRLVEEQKNETKVKITALLSVYDLSYEMSALLSSEERSEMHQQVIEKHRHVVQYYLDKYANPEIELQSHIVWNSNEADAINEEVENNNYDLVVKYTKDEEKLTSLIFTPIDWQLLRKCPIPVLMVRDGDWKHQRRILVAVNVSGEQEYQDEFNQELVETGISLAENLNRGNVHLVAAYPSAPINMAIDLPEFNTSGYENGIRGQHLINMKALRQKFGIDEDHTHVREGFPEEVIPEVAKEIEAELVILGTVGRTGLSAALLGNTAEHVISKLSCNLLGIKPSKKDD

SEQ ID NO: 4090 - protein, 257 aa, H. influenzae strain 86-028NP
MKNFVAGAQSGRKIQSGGCAIHCQDCSISQLCIPFTLNEQELDQLDNIIERKKPIQKSQVLFKAGDSLNSIYAIRSGTIKSYTISESGEEQITSFHLPGDLVGFDAITQMQHPSFAQALETAMVCEIPFDILDDLAGKMPKLRQQILRLMSSEIKSDQEMILLLSKMNAEERLAAFIHNLSKRYSARGFSAREFRLTMTRGDIGNYLGLTVETISRLLGRFQKLGVISVQGKYITINDLNGLIELTGTNKTKITLVK

SEQ ID NO: 4091 - protein, 118 aa, H. influenzae strain 86-028NP
LNEITPTKRGEKHEFNRLNRFLRHPVTDKYISDVSRIGDEELCFDIKSSVLDATFRKLKKLAEREYLHFHDTRREALTRLSKKVDVMTLAKISGHKDISILQNVYYAPDMAEVAELLD

SEQ ID NO: 4092 - protein, 129 aa, H. influenzae strain 86-028NP
MEPIKLSQKAEEEIVNAAKMAALSNLTEKSQNLITLEDIAIYFGRHYQTVAKIISKLPNFPKPVTVDQQNSRPRYIAGEVVRWGGSMLNILANRVIPPPPPYQGHNRHFVKSKYLYAQIFWLMSSHLLF

SEQ ID NO: 4093 - protein, 83 aa, H. influenzae strain 86-028NP
MTHLNLIPVFNGLIQNQPVQLCNARELHAFVESKQQYTDWIKNRINEYGFIQNEDYLVITERTNGRPRKEYHITLDMGKELRN

SEQ ID NO: 4094 - protein, 423 aa, H. influenzae strain 86-028NP
MKTVKARLTELKNLINTKINEDYEWMGEIKSPEIIKEIEQLYPLIEKIEKSGKSLEISYAKYISLQLIKKIIRILNKKRASNKWDEYDVNSFILSLIKLRMTIKELYLIEVKGELRTEEELNAIAADISKAKLNLEEHISLEEQLVENKKEFENLKNSLITLKKSYNDAQEQITEISQWHEQSEKLSGDISNYEFTAQNNLTKITTLATTAETNKPQIEKYHEDIEGMIKLFNKQKEEIEMIIEDANRASMAGSFKTQSENIDSKMKAVDKILLGSLVATSVISLFNYSTSLSAADSLNILQFLAKSIVTIPLLVIAWLKAKERAYLFRLREDYNYKYSSAMAFEGYKKQVQEQDPKLHQQLLQIAVDNLGINPTKVFDKDLKSTPLETIIDGVGKRLDKAVDGIKGEVNDIPKKTKELIDDE

SEQ ID NO: 4095 - protein, 67 aa, H. influenzae strain 86-028NP
MKKIAADKIALVMARDILKTNSQYLREVNEYVAEDIARFVSTLSSRLQESIDDSISSSDIFNAHKNQ

SEQ ID NO: 4096 - protein, 52 aa, H. influenzae strain 86-028NP
MEEKQEKSLSDKDKNLIKQAVLESADKNTNLTPSELAESVCSAVMFIDSYGR

SEQ ID NO: 4097 - protein, 73 aa, H. influenzae strain 86-028NP
MQEEMKRYAISYHFDGKRWATDVYAHSFEEAEEKLKAMSQGTVDGEIHLSVYIPENPLSKVSRLITRIAKKFM

SEQ ID NO: 4098 - protein, 111 aa, H. influenzae strain 86-028NP
MQTIYVKDFSQYPGPRYIKDGKASGEEFRDSILIPAIKRDPDIILNLDDTEGYGSSFLEETFGGAIRKGISPEVVLNLVKNLISNDDHDIIDEIKSYVEKEIEILSLKDNK

SEQ ID NO: 4099 - protein, 359 aa, H. influenzae strain 86-028NP
MDIRLWRSIVRQRTLRALTSKEKKIRQRGGKPKYKHLAHKSFNLFEVIAPYKIILAKEIGYEFVAFKEELEEKAKLAARSRSRLKLNFRDTDIIDAAACSVLIAVLDTIKSQYRTLKFQIVRPKSKPADHRKHIPYDVDAIFCHIGLYKSLGFNYTSSSSQENVKCWHYVYSDSADGEITKPLLDELKSMGVKGIYPSYIEAIANAVEHAYAQNIYSEREFPIKRWWMLLAILEGKLSLFVCDLGHGIPNTLEKTQKANVLSAIWNRLKQLGKPTKDCLYIKASTLIKETRTGLGHRGKGGSDIRAFIDKTPGSRLIIRSNRGMYVYNGKDKPDLTKESRYSINGTVVQWNIPLQEIKE

SEQ ID NO: 4100 - protein, 232 aa, H. influenzae strain 86-028NP
MTDLASRLNELMAKQGKNIVDLQKAVGVTYEMARRYTLGTATPRDNKIEAIAKYFGVTPAHLKYGTVDSLENQVTSNVKDVGSFDLWDRNTPLNSDEYAVPFYQDIRLAAGNGFADDIADYNNFKLRFSKSTLRKQGVQYENAVCVIADGNSMEPVIPDGTTVGIDLGNKTIRDGKIYAINHGGLLRIKLLYNMPNEQVKIRSYNTEEHPDEIAELQDISVLGKVFWYSVLL

SEQ ID NO: 4101 - protein, 62 aa, H. influenzae strain 86-028NP
MLPIEKAYEIVGGISAMARHFNLTPWAVSKWREKVPAERCAKIEELTDGKVKKSELRPDLWD

SEQ ID NO: 4102 - protein, 146 aa, H. influenzae strain 86-028NP
MEMKKVIIEMVDRIPGGRSAVAGFLGFTESELKNRLYQTKGQRFKNEELIAIQQEYGCTQFIDELCRLAGGRFVPDVAENELDKVELANLQLHELSARGLLFAALETALEDGEITSKEEDKIRQALSKHLAATQHSIECAIVLHKK

SEQ ID NO: 4103 - protein, 224 aa, H. influenzae strain 86-028NP
MNQLLTISKENTSTLTMSSREIAELINKNHSDLCRSIERLIAKEVIWGYQPMAYTHPQNGQTYYEYHLTKRDSLIVVAQNCPEFTAAIVDRWQALENQQKPTALIPQSFSEALMLAAQLQAEKERNAPKVAFVDHYVEVGTSKSFRETAKILKMPERALVNRLVEDKYLYRQSGVLLPYQSARTKDLFTVKTGTAEHGHNYTQTRVTSKGIEFIASRYASELML

SEQ ID NO: 4104 - protein, 252 aa, H. influenzae strain 86-028NP
MSMRLMVQAMNCKVGNPARKLVLLKLADNANDDGICFPSYQYIADKCEMTRRSAINHIEYLIKMGLVSKKERKNKDGSISNLYFLHLEQGSENFALGSENISLGSENFALGGSENISPRTSHSLEPVNEPKKTTQKSEAEMLLEQFGITGQLAKDFIAHRKAKKGVINQTQLNRLQKQADKAGISICEAVEICIERNWQGFNASWDWRDEKLRPNSPHLGQSHRNKPKFDDTQTGWSAGMNFIVDGTQWQIP

SEQ ID NO: 4105 - protein, 213 aa, H. influenzae strain 86-028NP
MANSITQNQINTLPPERTQRAEETINWLFQELKSIFPGWRAAFETGADYLSAKKTWLRVLVREKITRPQLENGICEAEKSLDKFLPSVGLFVYWCKAYDYHALGLPNEAELYQRYNTFLGYARFNRDEFQYRSKVEFWLLKNLYEKCKKKSEEDTLKAIPKLLTKAAEKVRSNFPFEDIPKMIPEKPSFYDKAKADKARDSLMAMMKGKGALQ

SEQ ID NO: 4106 - protein, 74 aa, H. influenzae strain 86-028NP
MTSYKCPKCGAELEDFYTPDYFISSSEWDDDRFRCNGHLIEPIPFPQVSKYSAVNRTKSCGYFGLEDLGVEYKE

SEQ ID NO: 4107 - protein, 138 aa, H. influenzae strain 86-028NP
MSQYKPFFLRDQRIKNNCLDLIKELPIDDKKPLVVKIQPITRSLEQNSKLHALLSDISKQCEFNGKKRDIDTWKMIMVSAHKIATGGQAEMVIGLEGEVINLRESTAQMSVKRLASLIEYITSWGVQNGVRFNDRWGF

SEQ ID NO: 4108 - protein, 129 aa, H. influenzae strain 86-028NP
MVRGHWLKALQKEVNKFIRLRDKGQPCIACGTVWKPSFQASHFIPQGRSSFLRFDERNIHSGCIRCNLFVGGGNIHGYRPRLVEKIGEQEVEWLEENQHRIKKWEISELKEMLKLYRLKNKELENEMQD

SEQ ID NO: 4109 - protein, 209 aa, H. influenzae strain 86-028NP
MYKADCVCQMHYFRFMRNGTYDLLPKPIRKYRRHNGKGYQLIFEPRHQLAMSDGYVYEHRFVIYSIYQNNLPNCKLCGCKLTWSSCHIDHIDNDITNNTLENLRPICRACNVMRSHTLIPKYTHKGHSKITFNGLTMTAAEWARQDGVTVAGNTILRRIRDGWSIERALFETSSTHPNAAVKHTTTKYKNRFEVKSTGISLDLRLQGDD

SEQ ID NO: 4110 - protein, 92 aa, H. influenzae strain 86-028NP
MKCDARYAEKYRMRPISDELGMEIDGYLGVIRKVTPELYDVFVLTYIKRWEKQEIWRYLHISRREYFNRLKTVKTSLLLLLSTEGKQCLFIA

SEQ ID NO: 4111 - protein, 325 aa, H. influenzae strain 86-028NP
MEQHMVSTSLTAEKRKERAEKAALARWEHKKALEELPLAIHEGVLSIGDKSLDVAVLQNDLRIISSASVFEALDRPNRGSRGGAITENEELIKLPAFMDANNLKPFINQDVIDVIKGVKYRTKDGKIKEGYDATILPVVCDIYLRAREEGALVGKQQNTAQKAEILIRSLAKVGIVALVDEVTGYQDARAKDALAKIFEAFVAKELQPWVKTFPLDYYKELCRLYGVQFPPKNNNQFPQFFGHITNNAVYARLAPELLPELKKSASKQAKKVKLHQFLTEDVGHPKLREHLSSIVTLLKLSKDKDNFYEMLDKIHPKLTLQEGQE

SEQ ID NO: 4112 - protein, 261 aa, H. influenzae strain 86-028NP
MFDSATNTIPKGNKSAGFLTSFELSNARFIGGFHQKEIKMTTQIQFSIFNFKNSPVRTITDPNSEIWFCGTDVCDILGYVNAPDAMKKHCKEAGIAKRYISYPSGRKEAIFINEPNLYRLIIKSRKPEAEPFEAWVFEEVLPQIRKTGKYQLQPQQLALPEPEKKFSFEFTEYELQQLVWLWFAFMRGIVTFQHIEKAFRVLGSNMSSQIYGQAYEYLSVLRSTNQILNRITSDFDIDQMTNWRVLKHLRGFNPKAVKIDF

SEQ ID NO: 4113 - protein, 60 aa, H. influenzae strain 86-028NP
VWRIFTPQIHEKGYIMFRILFAVALLWAAYELNLNQDCDGYICDTSSLITALHKPLDSAH

SEQ ID NO: 4114 - protein, 118 aa, H. influenzae strain 86-028NP
MPIKEPDVWALIWSWLQTNLSSSSAQSAFWALFISLLRFGFMRKKPAIRYVLIDAAMCASIAGVAVPICTHLFGHTEYSSFLGTMIGFVGTEKIREFLFKFINRRIEKDDNDDFRSDI

SEQ ID NO: 4115 - protein, 163 aa, H. influenzae strain 86-028NP
MQQAMFLAQCGHESGGFTRFKENLNYSWLGLSKTFRKYFPDPLIAKKYERKPELIANRVYANRLGNGDEKSGDGWKYRGRGLIQITGKDNYAAFRKWLGRDIEPDDVAGNLDLSVKTAVWYWKCYELAELNSVEKVTRRINGGLNGIDERCKLYRALMVTDND

SEQ ID NO: 4116 - protein, 107 aa, H. influenzae strain 86-028NP
MTKYIYMALAGVVVVLIGALRYQSSVIDELEITTKQQENTIQQQEDANKSLSLALQQERYAIIEQQERNNEIERIATENAESVKTIIKTQPCAHTRLPQSVLDRLHE

SEQ ID NO: 4117 - protein, 93 aa, H. influenzae strain 86-028NP
MLNQLKQSLRLNLVLTLVCLSLFLTACTNKITTKPEYIYPPQAYTAPCVKTAFTGETYGDVVIQLVKVTAERDKCASQVDHLNKWINQAKGGK

SEQ ID NO: 4118 - protein, 92 aa, H. influenzae strain 86-028NP
MNHLLTFYEKIIFTNPLETGIPEAVAKLALLNDYSALRAWREHLGLTQAEVASRLGISQAAYSQHENSQTLRKSTRIKIATALGINSAQLDF

SEQ ID NO: 4119 - protein, 170 aa, H. influenzae strain 86-028NP
MSDVKGKSTSGRGLTPKQEKFCQLYIELGNASEAYRQSYDCQDMKSESINRLAKKELDKIKIRSRVDVLQQEHRQRHNLTLDNIIADLQEYRDICMGRKPLTITTVVKNAQEGTAQSVNTECFVFEPTGANKALELLGKHLGMFTNKVDVTTDGKPLPTVINVTFSDEPA

SEQ ID NO: 4120 - protein, 447 aa, H. influenzae strain 86-028NP
MSQLNIQFPTKFRPLFESIWPFIIFYGGRGSGKSFSIARALVLRAYQSPVRVLCCREIQKSISDSVIQMLADQIEMLGLQNFFDVQKTQIIGQNGSRFTFAGLKTNITSIKSMTGIDVVWVEEGENVSKESWDILIPTIREDGSQIIVSFNPKNILDDTYQRFVIHPPERCKSVLVNWQDNPYFPKELMEDMEQMRERDYELYRHVYEGEPVADSDLAIIKPVWIECAVDAHLKLGFTAKGMKKVGFDVADEGADSNDNAFVHGSVVLDIEVWKNGDVIDSANRTNQSAVKFKADLIIFDSIGVGAGVKAHFKRLPKSLQVEGFNAGGAVAYPEREYIKGKKNQDMFSNIKAQSWWALRDRFYKTYRAVKHGDVYPDDELISLSSNIKELEYLKAELSRPRVDYDNNGRVKVESKKDMKKRGIPSPNMADALVMCYATTKPKSLLDL

SEQ ID NO: 4121 - protein, 444 aa, H. influenzae strain 86-028NP
MNILDGIKSLALKLGSKQDQTYYARGLSLTDDLMQIEALWRDNWIANKVCIKRSEDMVRNWRDIFSNDLKSEQLDEFTKLERRLKLRETLTKALQWSSLYGAVGLLLVTDTINITSPLQPTERLKRLIILPKWKISPTGQRDDDVFSPNFGRYSEYTIIGGTQSVLVHHSRLLIINANDAPLSDNDVWGVSDFEKIIDVLKRFDSASANVGDLIFESKIDIFKIAGLSDKISAGLENDVAHVISAVQSIKSATNSLLLDAENEYDRKELSFGGLKDLLTEFRNAVAGAADMPVTILFGQSVSGLASGDEDIQNYHESIHRLQETRLRPVLEVLDTLLCNELFGGQPDDWWFEFLPLTVVKQEQQVNMLNTFATAANTLIQNGVVNEYQVANELRESGLFANISAEDIEEMKNVNEFAGNFEEPENTEDAQVQASEDEQENGALV

SEQ ID NO: 4122 - protein, 393 aa, H. influenzae strain 86-028NP
MTDDVERAMQQPQGSFFMDDAKGFQAISAKALMKVLEKYEKSDRTSQAENIANGFVGRGDAQNHAEVSTNLKNQTGIDLSAYLRNSPNIAERVNALTAGNIQLIKSIRSQYLDKVQNTVMQAMVRGSLNKDLAAQVKDLGKTTEKRAMFIARDQSSKLNAALTQARHEEVGIKKYMWSTSGDERVRESHAEKDGQIFEYANPPADTGHPGHDVNCRCVQIPVLDDVVNLKSEETELSYQAAEPNKTGKMDLDELFESSIGGGGNKSFSNFGGVNSELITLAKESIGLDITDWQHSIDESSIRHILKQHGNEKAENKRGQRAVTKKDILLLPLVVSAFDSIEYTGTSDSGNETFLIKKEIDDEIFSVQEVRKRHKKIAVKTMWIKRKKKATSSA

SEQ ID NO: 4123 - protein, 58 aa, H. influenzae strain 86-028NP
MKFTDKTTQAATQRTITKDGFLVVPATISKVGVFDYLATELGLKEDGIKKVARTEKSL

SEQ ID NO: 4124 - protein, 339 aa, H. influenzae strain 86-028NP
MYQLFRHGIFQMDAEKAHDFTIQCLKLASNPLFQPILKSLIHAPKGFPKTVMGVNFPNPIGLAAGADKNGDAIDGFGTLGFGFLEVGTVTPVAQDGNAKPRQFRLIEAEGIINRNGFNNNGIDYLIENVKNARYKGVIGINIGKNKFTSLEQGKDDYIFCLNKAYNYAGYITVNISSPNTPDLRQLQYGDYFDDLLRSIKDRQAILANQYNKYVPIAVKIAPDLTESELVQIADTLVRHKMDGVIATNTTVSRDTVMGMKNAEQQGGLSGKPLQHKSTEIIKRLHQELKGQIPIIGSGGIDGLQNAQEKIEAGAELLQVYSGLIYHGPKLVKELVKNIK

SEQ ID NO: 4125 - protein, 274 aa, H. influenzae strain 86-028NP
MTKKYDLHCHSTASDGVLSPTELVHRAYAQGVNVLALCDHDTIVGIDEAEITAKEVGIELITGVEISTNWEGRGIHIVGLNFDKTHPKMTALLQSQKALREKRAVEIGDKLEKAGIPHAYDGAKALADGEVTRAHYARYLVQIGKVSNDGQAFKRYLGQGKSAFVKAEWADIPTAIETIHAAGGIAIIAHPLRYNMTGKWVRKLIVDFKAWGGDGMEMADCGQTKDQRQMLARWAKEFNLLGSVGSDFHFPCGWIELGKNLDLVDSVIPVWEKF

SEQ ID NO: 4126 - protein, 202 aa, H. influenzae strain 86-028NP
MKMKSLFVAMITFFSAAPFAHWQPIGNAEYTWGPFHVYTIGLFSETGTYQENERPLMLSFKYEKPIEGKNFAITLIKEIETLKLNDGDTQSWLKEMQATFPDFSPNDILNYIALPDRGYFVLNDTVLEHDFDAKFNQAFIGIWLAPNSTFVKLQPQLLGKTKSNHEATEFYLKPEIESFDEQDSTPELPPNYLLDSQKKSQG

SEQ ID NO: 4127 - protein, 464 aa, H. influenzae strain 86-028NP
MAFRIEKDTMGEVQVPADKYWAAQTERSRNNFKIGPAASMPHEIIEAFGYLKKAAAFANHDLGVLPLEKRDLIALACDEILANKLDDQFPLVIWQTGSGTQSNMNVNEVVANRAHVINGGKLGEKSIIHPNDDVNKSQSSNDTFPTAMHIAAYKKVVEHTIPCVERLQKTFAAKSEAFKNVVKIGRTHLMDATPLTLGQEFSAYAAQLDFGLKALKNTLPHLSQLALGGTAVGTGLNTPKGYDVKVADYIAKFTTLPFVTADNKFEALAAHDAIVETHGALRQLAMSLFKIANDIRLLASGPRSGIGEILIPENEPGSSIMPGKVNPTQCEAMTMVCAQVFGNDTTIAFVGSQGHFQLNVFNPVMIANFLQSAQLLGDACVSFDEHCAVGIEPNYPRIKQQLENSLMLVTALNTNIGYENAAKIAKTAHKNGTTLREEAINLGLVSAEDFDKWVRPEDMVGSLK

SEQ ID NO: 4128 - protein, 312 aa, H. influenzae strain 86-028NP
MNIVFTLDCNFASHLDTVLKSLCYHHNNINIYVIHDGIPAESLEKLKMHCAKFDNTLYDIQFNINQFSFPTVISPAHIQSTASLFRLYLHQILPQHIERVIYLDMDLIIHQAIDELWDINLEDSLIAGVSDFFSEYLWEHPFYEKQQYINAGVMLINLNKWRENNIEQYFIEYAAKYGEFFVYGDQDVINFSIPTNLIKLLPVKFNIQVKFIEYLWMEHKEKIKFTPHIIHYIGSNKPWLKEHSANSPRFYNEEYLFYHHLSWDNLRQTDRQTDRQTDRQTDRQTEKYNPIALYVKVRLILTAFFLLEGKLH

SEQ ID NO: 4129 - protein, 144 aa, H. influenzae strain 86-028NP
MAKTAQFYILTENCTLTVEEIACNLAASIWRSGKKVLISCESESQALEIDELLWQRDPNEFVPHNLSGEATQYPTPIEISWLGKRNLQHRDLLINLQQEIPDFSHSFTQIIDFVPKDDALKTQARERYKQLRLQGWNLSTENVG

SEQ ID NO: 4130 - protein, 56 aa, H. influenzae strain 86-028NP
MTEREKIIQQQKQLKALFSVWMKEKMNHEVVIFQKTDGKIVEHYLDGSEKIVGYAK

SEQ ID NO: 4131 - protein, 124 aa, H. influenzae strain 86-028NP
LWKNGSGKSTLRSFNQDAVQIVIDSDHIAMQINPQNPRLADIDAGRKAIGLFRFAIKLHIDFSMESTLSGNSIIQRIKNAKENGFYVHLNYIGINRIEINLARIKARVKSGGHFIAEDIVKYRY

SEQ ID NO: 4132 - protein, 55 aa, H. influenzae strain 86-028NP
LSYCDEIFIYDNSSIAPELIFQLKDNCITQFSEFLPSWCEKILNNLRNLGFEKIF

SEQ ID NO: 4133 - protein, 104 aa, H. influenzae strain 86-028NP
MQPNEITFYQRFEADILAGRKTITIRDKSESHFKAGDILRVGRFEDNQYFCTIEVLSVSPITLDELTEQHAKQENMGLDKLKEVIKTIYPNEHESWIINFKLIG

SEQ ID NO: 4134 - protein, 133 aa, H. influenzae strain 86-028NP
MNFSYILEQLKSFTIEDVILKICYFVISIIVGKVSRQCWKLIRIYVNECRTIRELSESDKEFIQNNNFEFEVDKENEYQNLEELKRKGLVNIEFCEDELQDASGIYLCTVTNKNRLKISLTKFGKQIKYLIEK

SEQ ID NO: 4135 - protein, 954 aa, H. influenzae strain 86-028NP
MTQKFEMADRFNPSAVEQALYQHWEESGYFKPSENENAPSYCIAIPPPNVTGSLHMGHAFQQTLMDTLIRFNRMEGHNTLWQAGTDHAGIATQMVVERKIAAEEGKTRHDYGREAFINKIWDWKAYSGGTISQQMRRLGNSIDWERERFTMDDGLSNAVKEVFVRLHEEGLIYRGKRLVNWDPKLHTAISDLEVENKESKGSLWHFRYPLANGAKTADGKDYLVVATTRPETMLGDTAVAVHPEDERYQSLIGKTVVLPLANREIPIIADEYVDREFGTGVVKITPAHDFNDYEVGKRHNLPMVNVLTLNANIRDEAEIIGTDGKPLAGYEATIPADYRGLERFAARKKIVADFEALGLLDEIKPHDLKVPYGDRGGVPIEPMLTDQWYVSVKPLADVAIKAVEDGEIQFVPKQYENLYFSWMRDIQDWCISRQLWWGHRIPAWYDAEGNVYVARNEEEVRSKYNLDSAVELKQDEDVLDTWFSSGLWTFSTLGWPEQTKELKMFHPTDVLITGFDIIFFWVARMIMFTMHFVKDENGKPQVPFKTVYVTGLIRDEQGQKMSKSKGNVLDPIDMIDGISLEDLLEKRTGNMMQPQLAEKIAKATRKEFADGIAAHGTDALRFTLAALASNGRDINWDMKRLEGYRNFCNKLWNASRFVLTNEKLDLSEGEIEFSLADRWIQSEFNRTVETFRNSLSQYRFDLCANAIYEFTWNQFCDWYLELTKPVFANGNAAQIRAASQTLVHVLEKLLRLAHPLIPFITEEIWQKVKGFVGITADSIMLQPFPQVEENGFDLEAEAEIEWLKEVIVAVRNIRAESNIAPSKGLDLLFRNLSAENAKILEKQTALLKAMAKLDNVQVLAANEAAPLAVAKLVGNAELLVPMAGFINKEAELARLTKEIEKYQNEVKRIENKLSNESFVAKAPEAVIAKEREKQAEYQSGLEKIQEQYKAIEAL

SEQ ID NO: 4136 - protein, 35 aa, H. influenzae strain 86-028NP
MSVIDEDEAKKTQEALITMSQLEHEVGDFLGLNQK

SEQ ID NO: 4137 - protein, 477 aa, H. influenzae strain 86-028NP
MMITQDFTKPIDSATVLQKIVLDKAQWVKAKEKEFPLSQFKQNIQNSDRSFYDALAKGTHQKPAYILECKKASPSKGLIRAEFNLEEIANVYKHYASAVSVLTDEKYFQGNFEFLPLVRGIVSQPVLCKDFMISEYQVYLARYYQADAILLMLSVVNDETYRVLAELAHSLGMGVLTETSNEEEFERALALGAKIIGVNNRNLHDLTVDLNRVVKLTEKYADRIPADVRIISESGIYNHKQIHQLQKVAHGFLIGSSLMGNQDLNNAVRSVIFGENKVCGLTRTQDVKIVYENGALYGGLIFVEHSKRCVSLRQAQELVTAAPLRFVGVFQNQEIDFIVKIANQLQLYAVQLHGAETEAFITALRQQLPKNTQIWKAISVNTEAQSTVDFTDDLNVDRYIFDSQTANQQGGTGKTFDWSLIPEHLKHKIILAGGISPNNVEQAIQQNCLGLDLNSGVESSVGVKDQEKVRLVFNNIY

SEQ ID NO: 4138 - protein, 333 aa, H. influenzae strain 86-028NP
MQHNQLLEQLYSGHSLSTSESTALFNAVIQGELSNEQIAAMLIALKVREANTEEITGAVAASLQNAKVFPRPDYPFADIVGTGGDGQNTINISTASAIVAASMGAKVAKHGNRSVSSKSGASDVLTALGVNVNVTPEQARQALDEIGVCFLFAQQYHSGFRHVAPVRTALKTHTIFNILGPLINPARPTYHLLGVYAPELVKTYAETAVALEHQHSFVVHGSGLDEVALHGETQVAEIKNGKIEYFTLTPEDFGLKTQSLESLRGGEPQENTQYLTALLQGKGKAEHANAVAANTALLLKLFGYDDLKQNVQNVLAHLASGNAFKTLQKLTTY

SEQ ID NO: 4139 - protein, 128 aa, H. influenzae strain 86-028NP
MITVFGLKSKLAPRREQLAEVIYNSLHLGLDIPKGKHAIRFLCLEKEDFYYPFDRSDDYTVIEINLMAGRMEGTKKRLIKMLFSELEYKLGIRAHDVEITIKEQPAHCWGFRGMTGDEARDLDYDIYV

SEQ ID NO: 4140 - protein, 195 aa, H. influenzae strain 86-028NP
MANILFLDNFDSFTYNLVDQFRVLGHNVTIYRNDCDLEKLVETALNINTLDTILALSPGPGTPSEAGILLPLIERLKNQVPIIGICLGHQALIQAFGGKVVHAGEVLHGKVSRISHDNEAMFKDLANPMPAARYHSLMGQDLPKEFIVNAEYNGIIMAIRHRDLPICAFQFHPESILTVQGSQLLQQSIEWLLNR

SEQ ID NO: 4141 - protein, 518 aa, H. influenzae strain 86-028NP
MNIQTQAFIAVTAQSIPYYADTTAIFNTLCQPNSNSLLLDSAEIGSKNSLQSLILVNAAVKITCLGHNVTFKALNKNGKQVLKEIHPKLTALGKISAVNFEDEFSVQFSPLDNQLDEDNKLQSATIFDGLRVVSTLYQHSQTPIFLGGLFAYDLVANFIPMDGITLKNDGINCPDYSFYLAEHLITIDHQNQQATLKSFCFAQEEQVNIAKTSLSIAQKLKNIDHVLSIKSASDEVKTNFDDPEFTGIVKALKHHINIGDVFQIVPSRRFSLACPNTLASYAQLKQNNPSPYMFYMNDEDFILFGASPESALKYAPENRQLEIYPIAGSRPRGFDAHGNIDPELDARLELELRLDHKEQAEHLMLVDLARNDIARVCQNGTRKVAELMQVDRYSHIMHLVSRVVGKLRPELDALHAYQACMNMGTLTGAPKIKAMQLIYQFEQQKRHSYGGAVGYLTSDGHFDTCIVIRSAFVQNGIAHVQAGCGEVLDSDPQMEADETRHKAAAVLKAIRQVNTQAK

SEQ ID NO: 4142 - protein, 294 aa, H. influenzae strain 86-028NP
NQPTNQPTNQPTNQPTNQPTNQNNKTVAVVTSTIGRPELSLAIKSVQNQTYPCKHYVFVDGNIFWDKAKSILEQFPDVIPIYLPMNTGKNGILNGAINAVAAFLVEEDIICYLDDDNQLREDHVESLVNVIEQGADFAYSLRSFYDSNHQFICNDDFDSLGNWNTKSDIFVDVKIEDIQKQIHFTFNEVNGHIDTNCYAVPREIAQKTSYSWNTPLIGDRSFLSALKSLGLIGQTSGKYTVKYRADFNKLIAVRRVFPQLSLSDEDNNNISAKILEVINQQNIEYYGGRPWAKE

SEQ ID NO: 4143 - protein, 165 aa, H. influenzae strain 86-028NP
MLSENVVKLLNDQMNLEFYSSNLYLQMSAWCDQQGFEGTAKFLSVHAAEEMQHMRKLFTYLNETGSLAVISAIEAPAHEYKSLKEVIEATYEHEKLITSKINELVGKTFEEKDYSAFNFLQWYVEEQHEEEKLFSSILDKLNFLGEDGKGLFLIDKDLGNLSTKA

SEQ ID NO: 4144 - protein, 182 aa, H. influenzae strain 86-028NP
MIAANYALLHFINQNGKELVMLNQIIINKLNDQINLEFYSSNVYLQMSAWCSKHGYEGAATFLLRHADEELEHMQKLFNYVSETSGMPILGKIDAPKHDYSSLREVFEITLEHEKLVTSKINELVEVTFESKDYSTFNFLQWYVAEQHEEEKLFSGIIDRFNLVGEDGKGLFFIDRELATLE

SEQ ID NO: 4145 - protein, 339 aa, H. influenzae strain 86-028NP
MFMHKMKKNLIIVLTLGTLPFAQANSITGAGASFPYPIYAKWASLYEKETGNKVNYQSIGSGGGQQQIIAKTVDFGASDDPMKSELLQQHQLVQFPAVIGGIVPVVNLPEIKPGKLKLSGKLLAEIFLGKIKKWNDPDLVALNPTLPLPNKNIIVIHRSDGSGTTFGFTNYLSKVSNDWKNQVGEGKSVKWLTGQGGKGNEGVASYVRQMKYSIGYVEYAYAKQNQLAWISLQNQAGQFVQPSNESFMAAASHAKWHEKAGMGVILTNETGEKSWPITAASFILLNKYSDNPETTKNVLAFFDWAFSRGQDAATELDYVPIPADVVSTIKSQWKTELKQ

SEQ ID NO: 4146 - protein, 315 aa, H. influenzae strain 86-028NP
MLTKSRKYFNQTWIESLFKQTTALFALLVFILLAAILISLVIGSWESIKRFGGSFLLETYWDPVQEQYGAIIPILGTLITAGIALFIAVPISFGIAIFLTELAPNWLKRPISIAIEMLAAIPSIIYGMWGLFVFVPLFQEHIQPVLIDNLGNLPGLELFFSGVPFGVGLFTAGLVLAIMIIPFIASVMRDVFSIVPPMLKEGAYGLGATTWEVVRQVIVPHTRIGLVGSVMLGLGRALGETMAITFIIGNSFQLPNSLFSPSTSIASAIANEFNEAGGLQKSALMELGLLLFVITTMVLILSRLMITKMQQTKGK

SEQ ID NO: 4147 - protein, 282 aa, H. influenzae strain 86-028NP
MKTNQNLRFYWRKTHNKLMLGLSYISVIIGLFWLCWILFTLITKGIPALSIDLFTQSTPAPNEKGGLLNALIGSFFIVGAGTLIGTPIGVLAGTYLAEYGRYSRFAQITRFLNDILLSAPSIIIGLFVYSLYVSKIEHFSGWAGAFALALLLIPIVVRTTDNMLLLVPNNLREAAAALGCSQWQVIMMICYRAAKSGILTGVLLAVARISGETAPLLFTALSNQFLSWNMNEPIANLPVVIYQYAASPFTDWNNLAWAGAALITLFVLCLNIFTRLFFQHKK

SEQ ID NO: 4148 - protein, 255 aa, H. influenzae strain 86-028NP
MISLQETKIAVQNLNFYYEDFHALKNINLRIAKNKVTAFIGPSGCGKSTLLRSFNRMFELYPNQKATGEINLDGENLLTTKMDISLIRAKVGMVFQKPTPFPMSIYDNIAFGVRLFEKLSKEKMNERVEWALTKAALWNEVKDKLHKSGDSLSGGQQQRLCIARGIAIKPSVLLLDEPCSALDPISTMKIEELITELKQDYTVVIVTHNMQQATRCSDYTAFMYLGELVEFGQTQQIFDRPKIQRTEDYIRGKMG

SEQ ID NO: 4149 - protein, 231 aa, H. influenzae strain 86-028NP
MTRKILIVEDECAIREMIALFLSQKYYDVIEASDFKTAINKIKENPKLILLDWMLPGRSGIQFIQYIKKQESYAAIPIIMLTAKSTEEDCIACLNAGADDYITKPFSPQILLARIEAVWRRIYEQQSQFIQIDELSIDENAQRVFFQQQEINLSSTEFKLLHFFMRHPEKVYSREQLLNRIWHNDLEVEYRTVDSYIRRLRRNLAPFQCEHYIQTVRGSGYRFSSYLRDKQ

SEQ ID NO: 4150 - protein, 425 aa, H. influenzae strain 86-028NP
MKKILNFIVEINLAIIISLFTSDFILWFAIILLLILAWHHINEYRLLKYLNLKQDNKFSLLQLGTFSQTEAYHRHQIYKEKCASLRLLSQINKNIKYLPDAIIICQHNGNISWCNSIAQQMFDFCWNKKVQKNIFDVIFYEQFKHYFFSQKKRRPLVLLTYNQRYIEVQSHAYNSHMILVIARDITDMIHLLNSRQKFLSNINHELRTPLTVLQGYLEILADNNIQNPLQKKAIFAMQEQSQRMEHLLQQFNFLAKIETTSDKDFRKFDMSAMINSLRKDTDILNTYNHHIEFIIQPNIIIFGNESQLRSAVSNLIYNAIKHSGKQCHIQIQWETCEQGIKFNVIDNGVGISPQHIPHLTERFYRVDESRSHLTGGSGLGLAIVKHTLLQYHSHLNIESTETKGSSFSFIIPKRFVISKNNKEIQ

SEQ ID NO: 4151 - protein, 473 aa, H. influenzae strain 86-028NP
MAKDFSFFIYDYESFGVNPATDRPAQFAGIRTDADFNIIGKPIMFYCKQTNDYLPAPEAVMVTGITPQECNEKGLSEPEFAANILAEFSQPNTCVMGYNNIRYDDEMTRYTFYRNFIDPYEYSWKNGNSRWDLLDLVRACYALRPEGINWAYDDDGMPSFRLEKLTKANGIEHENAHDAMADVYATIAMAKLIKEKQPKLFQYFFENRGKKEIEKLVDTGAMTPLVHVSGMLGNYRGNCTWVAPLSWHPTNQNALIVCDLTGDIDNLLAKSADELRTDLYTKKSELEERGVSSVPLKLVHINKCPILAPAKTLLPETANRLGIDRQLCLDNLAKLRASFDIREKVADIFNEERQFASNDNVETELYNGFFSNADKNNMAILRSLPAEKLSEHGLAFEDKRILELLFHYRARHFYKTLTRAEQIKWQKYRQNKLEKSAVEFQSGLQRLAEEHSDNSEKLSLLQQVYEYGIKLLG

SEQ ID NO: 4152 - protein, 291 aa, H. influenzae strain 86-028NP
MHNLIFAILCSVAVSVLLKIARKKNIIIEQAIAFNYITAITFSYFLLKPDFKGLEFTDYIAQSENSPIFLALGLLLPSVFIIMSKAVEFAGIVRSDAAQRLSLFLPILAAFLIFHETLSQSKIIGVVLAFIGLFCLLTKPTQGQSAVNFKGVLGLIGVWFGYGIIDILFKQVAKSGGAFPATLFISFSLAACVMFIYLFLKRAQWTSSSVIGGIVLGVLNFFNILFYIKAHQSFAGNPTLVFAGMNIGVICLGTITGALVFKEKISKLNWLGIIFSLSAIFCLYYLDKLIA

SEQ ID NO: 4153 - protein, 302 aa, H. influenzae strain 86-028NP
MKIFTSKKGQLSQLKQQKFKLEKDIQRLFEENLTLLSGYIFIRSEFSIKNSRIDTLAFDPETQAFVIIEYKRQQNSSVVDQGISYLNLMLEYKADFIVEYNEKQKAPLKRNDVDWSQSKVIFVSPTFNDFQIQATNFKDLPIELWEVNRFDNDIITLNIINKSKSAPNIKAVSIEKNEEFSTLKEIKVYQESDHLSDKSDFIQELYEDFKQGILNLDPNIEINTRKLYIAFKKDRNIADIRIQQKNLKIWINLPYGELDDPKNLAKNVSNTGHWGNGDYEITIESTQYLEYIMSLIKQAIKD

SEQ ID NO: 4154 - protein, 1510 aa, H. influenzae strain 86-028NP
MSDVFELENEIELESDEVIMENENVEEIVDAPMPFSMTTNNGVERGKFRSLTLINWNGFFARTFDLDELVTTLSGGNGAGKSTTMAGFVTALIPDLTLLHFRNTTEAGSTGGSRDKGLHGKLRPGVCYAVLDTINSRHQRILVGVRLQQIAGRDKKVDLKTFSIQGVELSQNPTALFTETVGERQARVLNLNELKDKIENIGAQFKQYHSITDYHGMMFDLGIIPKRLRSASDRSKFYKLIEASLYGGISSAITRSLRDYLLPENLGVRKAFQDMESALRENRMTLEAIKVTQSDRNLFKHLITETTNYVASDYMRNANERRGNIEAALESRREWYKAKAEQNLSQHRLVDLSREAAELAENERTLEVDHQSAVDHLNLVLNALRHQEKITRYQEDIAELTERLEEQKIVVEDANDALEESQAQFEQTEIEIDAVRAQLADYQQALDAQQTRALQYQQAITALEKAKTLCGLADLSVKNVEDYHAEFEAHAESLTETVLELEHKMSISEAAKSQFDKAYQLVCKIAGEIPRSSAWESAKELLREYPSQKLQAQQTPQLRTKLHELEQRYAQQQSAVKLLNDFNQRANLSLQTAEELEDYHAEQEALIEDISARLSEQVENRSTLRQKRENLTALYDENARKAPAWLTAQAALERLEQQSGETFEHSQDVMNFMQSQLVKERELTMQRDQLEQKRLQLDEQISRLSQPDGSEDPRLNMLAERFGGVLLSELYDDVTIEDAPYFSALYGPARHAIVVRDLNAVREQLAQLEDCPDDLYLIEGDPTAFDDSVLSAQELELGVVVQVSDRELRYSRFPEIPLFGRAAREKRLEELQIERDEVAEQYAQIAFDVQKCQRLHEHFSQFVGLHLALAFQPNPEELMSEINRERNEIDRELNQFNNGEQQLRIQLDNAKEKLQLLNKLIPQLNVLTDEDLIDRIEECREQLDIAEQDEYFIRQYGVTLSQLEPIANSLQSDPENYDGLKNELTQAIERQKQVQQRVFALADVVQRKHHFGYEDAGQAKTSELNEKLRQRLEQMQAQRDMQREQVRQKQSQFAEYNRVLIQLQSSYDSKYQLLNELISEISDLGVRADDGAEERARIRRDELHQQLSTSRQRRSYVEKQLTLIESEADNLNRLIRKTERDYKTQRELVVAAKVSWCVVLRLSRNSDMEKRLNRRELAYLSADELRSMSDKALGALRTAVADNEYLRDSLRVSEDSRKPENKVRFFIAVYQHLRERIRQDIIKTDDPIDAIEQMEIELSRLTAELTGREKKLAISSESVANIMRKTIQREQNRIRMLNQGLQNISFGQVKSVRLVVNIRDTHAMLLDALSGQQDEYQDLFNDNCITFSEAMAKLYQRINPHIDMGQRTAQTIGEELLDYRNYLELEVEVFRGADGWLRAESGALSTGEAIGTGMSILLMVVQSWEEESRRIRGKDIVPCRLLFLDEAARLDGKSISTLFELCERLDMQLLIAAPENISPEKGTTYKLVRKIAGNQEHVHVVGLRGFGATE

SEQ ID NO: 4155 - protein, 244 aa, H. influenzae strain 86-028NP
MTDNLQDVISPKLAVAIANPIFPAVDSLLRSGRHISTEHLDNHAFLMDFQNELDGFYRRYNVELIRAPEGFFYLRPKATTLIARSVLSELEMLVGKVLCYLYLSPERLAQQGIFSTQEVYDELLNLADEGKLLKAVNQRSSGSDLDKQKLAEKVRAAIGRLRRLGMIQTVGEQNSGKFTISESVFRFGAEVRSGDDPLEAQARLIRDGEAATPESLSLEKQAQLVENDTESADEIDEEFDGEQE

SEQ ID NO: 4156 - protein, 352 aa, H. influenzae strain 86-028NP
MNDIQVAKESLDKIIKKARVHLYKPIQIAEILYQDRVNKNINLLDKETYRNISKKWRDVICIRFLGRVSTSSAKYQDDLFNDNAMPPKHLNILGEMNRKTNGGVESYIYKKFFERFNQMSSALEYSYSRTPDNFHLSEFLALFWLEPGLKRSIDKVYEIVVYALFSSLIEALGVKVKIDLDLSNIDLLKEFEDFTRQIISLDSENTSLELNAKINRVGVTNASDRGLDMWANFGMAIQIKHLSLTEELAENIVSSVSSDRIVIVCKESEEKLILSLLNQIGWRSKIQSIITEADLIKWYDKALRGKSAYLVGSKILEHIRNEISLEFPATDIVDFNHFFHECEYNKALDIEK

SEQ ID NO: 4157 - protein, 318 aa, H. influenzae strain 86-028NP
MKEYKTIDLFAGIGGIRLGFEAFGCKNVFSSEWDKYAQSMYEVNFGEKPFGDINDISPSDIPDHDILLAGFPCQPFSIAGKGLGFADTRGTLFFNIEAILKAKKPKAFLLENVKRLTTHDNGNTFKVINDKLNKLGYTVYHKVLNTLDFGLPQKRERIYIVGFLDKLHFEFPKPIGKYEELSNILESDDVVPNNYFLSDELKRKRLSSITKDVPYPSIWHENISGNVSALPYSCALRAGGSYNYLVVNGVRRLTGREMLRLQGFPDTFEINIPYSQVRKVAGNSVSIPVIRAIAGSMINSLNMATPKINQAIQLSLLD

SEQ ID NO: 4158 - protein, 475 aa, H. influenzae strain 86-028NP
VRSIQKKIFKIRKKSCIIFPIFCSILTLCNSMIETSQTIPELVSWAKDREFSLNLPTERLVFLLAIAIYNNERLDGEMLEADLVDIFRHTMNAFEQSTDAIATRANNAINELVKQRLLNRFSSEFTEGLAIYRLTPLGVGVSDYYIRQREFSALRLSVQLSIVADEIQRASDSAEEGVENNESEHYWRRNVFAPLKYSVAEIFDSIDLSQRIMDENQQSIKDEIAELLTKDWQAAISSCERLLDETSGNLRELQDTLNAAGDKLQAQLLRIQDCVIGRDDLYFIDQLITDLQSKLDRIISWGQQAIDLWIGYDRHVHKFIRTAIDMDKNRVFSQRLRNSIHHYFEHPWFLWTAQAERLVDLRDEEMVLREDDALGELPEELQYESLSDLHDQIVEHMQGLLIAYRENNRPIDLSLVLKEQLENYPLSRHFDVARIIVDQAVRLGMANDDLSGIYPDWQAINKRGAEVQAHVIDKY

SEQ ID NO: 4159 - protein, 310 aa, H. influenzae strain 86-028NP
MTQLAQQEKKQTYNFNKLQKRLRRNVGNAITDFGMIEDGDKVMVCLSGGKDSYTLLDILLNLQQNAPIKFDIVAVNLDQKQPGFPEHVLPEYLESIGVDYKIVQENTYGIVKEKIPEGKTTCSLCSRLRRGILYRTATELGATKIALGHHRDDMLATLFLNMFYGGKMKSMPPKLISDDGKQIVIRPLAYCKEKDIEKYAIAKEFPIIPCNLCGSQPNLQRQVVKEMLNTWDRQYPGRLETMFSAMQNITLSHMCDPKLFDFKGIKHGQLIDGIEGDTAFDEEKITPMQFEDEDQTDFSNNEMINFKEVN

SEQ ID NO: 4160 - protein, 109 aa, H. influenzae strain 86-028NP
MLNINGIEVETDKDGYLLHSQQWNEDVARAIARLESIELTDAHWEVIYFVRDFYQEYNTSPAIRMLVKAMAEKLGADKGNSRYLQRLFPEGPAKQATKLAGLPKPAKCL

SEQ ID NO: 4161 - protein, 69 aa, H. influenzae strain 86-028NP
MKISARNQLKGKVVSIENGSVNAIVHIDIGGGNVLSSTVSLAAVKELNLEVGKEAYAIIKATSVMVGVE

SEQ ID NO: 4162 - protein, 926 aa, H. influenzae strain 86-028NP
MKKTTALFLLIFSLIACQSLELSPNNDLPFDPNIQHGKLSNGLQYFVLKNTEPKERVYIRLVINAGSMHEDDDQKGIAHLVEHMAFNGSKKYPENQIINALEKLGMKFARDINAFTDFENTVYTLNLDSNNQQKLELAFDVINEWMNNITFLPKDVDGERGVVQEEWRRRLSPMLRIGNKKSAIEMAGSRYVLRDPIGDMDIIKTISAKRVADFYHKWYRPDNMSVIIVGDIDTKQVVKLLKQNLSQENPITKTTLEKIDFNIPLINKWRLDSISEQGTTIPSIELSFFENTIETNTLASYKQELIQQITTRLLNLRLQQWEKETENGVDSANFYRTHLGKETLQSIFSLQLIDTQYSKTIDKLFAFIASIKQQGFTQNELNGEIKRLTQLNEKQLNIRSGSLKIADDLITSVANKQVVLSVNDRYELNKRFLSQITLADLQRTLNQTLALKAKLLLITQPLPQKALPFDVVEIETRWNNAMKMQQHQWDEKKQIEKLPHLTFNTGSLSQEKYWDRGDIYEFRLSNGSKLIYHYSDKTPNQVHFRAVTQGGLRSIPDKDYHLLRAAVSVVDETGVGELSLSAVNQIFSRDPLVIATVIDDDKQGFTGVSKPKDLENLLTLFRLKLRSSPISDLALEKYRRETRDYFKQIDLETQFMQAVSKLRFPNIETVYTQKQAQQLAFDKNQLSNAYQRYILNKTDFTYFIIGDIELNQVKKLAERYLASVESKTQIRHFVPTIIHTPTQSFIMNGLKEPRADVEIYLTADNTWRAEQKYLFNILADIVQEKLRLILREKVSGVYSVNSWFMQDVHTPQIEGKIEFSCDPKRVEELTHLTNQVLDDIVKNGIDENLLRKKLAEQHTQIRREFDSLVSVASIIEESYWQQDNPDAIYTYQHLDQLATKATIDALAQKALKKSGRFVSVLKAATY

SEQ ID NO: 4163 - protein, 643 aa, H. influenzae strain 86-028NP
MPIITLPDGSQRQFDRPVSVLEVAQDIGAGLAKATIAGRVNGERRDACDVIEQDATLEIITAKDEDGLEIIRHSCAHLLGHAIKQLFPDVKMAIGPTIENGFYYDVDLDRSLTQEDIDAIEKRMLELAKTNYDVVKKRVTWQEARDTFEKRGEPYKMAILDENIERTATPALYHHLEYIDMCRGPHVPNMRFCQHFKLQKVAGAYWRGDSKNKMLQRIYGTAWADKKQLAEYLTRLEEAAKRDHRKIGKALDLYHMQEEAPGMVFWHNDGWTIFRELETFVRTKLKQYDYQEVKGPFMMDRVLWEKTGHWQNYADLMFTTQSENREYAIKPMNCPGHVQIFNQGLKSYRDLPIRMAEFGSCHRNEPSGSLHGLMRVRGFTQDDAHIFCTEDQIESEVTSCIKMVYDIYSTFGFTNIAVKLSTRPENRIGSDEMWDRAEAGLAAALAHNGLEYEIQEGEGAFYGPKIEFALRDCLGREWQCGTVQLDFALPGRLDATYVAEDNSRKTPVMIHRAILGSIERFIGIITEEYAGFFPAWLAPTQAVVMNITDSQADYVQQVVKTLSDAGLRVKADLRNEKVGFKIREHTLRRVPYMLVCGDKEIAEGKVAVRTRKGADLGTFTVEEFAEILKNQVRSRELKLLNEE

SEQ ID NO: 4164 - protein, 194 aa, H. influenzae strain 86-028NP
MSNVLVLKSSISGNNSQTNQLADYVIEKLQGNNIVVRDLSQQPLPYFDTAAAIAVRGEPKTTEEKQLLALSDKLIEELKNAQTLIIGAPMYNLNVPTQLKSYFDFIARPRVTFQYTANGSEGLLKGKKAIVLCAFGGLYDEENLVTQYMKSILGFIGITDVQFVYAQGIGFGPEAIEKAQASAKNKINEIVAAL

SEQ ID NO: 4165 - protein, 868 aa, H. influenzae strain 86-028NP
MSKSLVIVESPAKAKTINKYLGSQYVVKSSVGHIRDLPTVGSSTGEKAKPISTKGMDAEEKAKIKAEKERNALVKRMGIDPYHDWKANYQILPGKEKVVSELKSLAKKADHIYLATDLDREGEAIAWHLREVIGGNNDRFSRVVFNEITKNAIKQAFEKPEQLNMDRVNAQQTRRFLDRVVGFMVSPLLWKKVARGLSAGRVQSVAVKLLVEREREIKAFQPEEYWEVAVLTNNQNKQAIRLDVTDYKGKKFDPKNQKEAQSAVDFLNVSDYVVTDLETKPTSSRPRAPFITSTLQQTASTRLGFGVKKTMMLAQRLYEAGYITYMRTDSTNLSQDALNMARSYIENHFGAQYLPEKPNFYSSKENAQEAHEAIRPSDIRALPESLEGMEKDAVRLYDLIWRQFLACQMPPAQYDSSTLTVSAGDYTLKAKGRILRFDGWTKVLPQIGKNPEDQELPSVTVSEKLALKEVQPTQHFTKPPARFTEAALVKELEKRGIGRPSTYAAIISTIQERGYVRTENRRFYAEKMGEIVTDRLNESFGELMNYDFTANMEDTLDKIASGSVNWKTELNQFFKDFSSQLSKAELDELEGGMRPNNLVETDIKCPTCDRNMAIRTASTGVFLGCSGYALPPKERCKTTINLIPEAELLNVLDESSETKALMDRKRCTKCGTAMDSYVIDAHRKIHICGNNPNCDGYLIEEGSFKIKGYDGPVVECDKCGADMHLKLGRFGKYMGCTNCDNTRKILKSGEVAPPKEEPVHFPELKCEKSDAYFVLRDGASGVFMSAHNFPKSRETRPVKIAELVQYRERLPEKLAYLADAPQKDPEENEAIVRFSRKEKKQYVTSEKEGKATKWIVDFTNGKWVERKK

SEQ ID NO: 4166 - protein, 305 aa, H. influenzae strain 86-028NP
MDKLNAISIFCKVIETQSFTLAAKQQNISVAMASKLVSQLEEHLKTRLLQRTTRKIMPTEAGIMYYQRCQGILLDLDEADSSITHLTSSLQGNLLISVPRDFGLLFIAPNLPTFMAKHPHLHIEVEFNDKKIDLLSEGYDLALRIGYMEDSSLVSRKIGTTTVHFAASPNYLETNGIPQTPDDLEHHNGLLYKNAMNQVNWVGSRINQTQRFKIQSKVVSNSGFALLNMAKAGLGIANLPKFILGRAFEKGELIEILPEYKQQKLEIHVVYPNRRHLPIKVRAFIEFLSGLGLCSEILENHEDNI

SEQ ID NO: 4167 - protein, 474 aa, H. influenzae strain 86-028NP
MSEGLVQAAYILAALLFIMSLAGLSKHETAKAGCWFGIVGMTIALIATIFGPHSEGTFWIIIAMIIGGAIGVQRALKVEMTEMPELVAILHSFVGLAAVLVGFNSYGLHHEALMPEGLDAAAQAAFVAEQVVLTNIHNVEVFLGIFIGAVTFTGSVVAFGKLSGKINSKALMLPHRHKLNLAALVVSALLMVAFLNNPESIFPVLLMTAIALAFGWHLVASIGGADMPVVVSMLNSYSGWAAAAAGFMLNNDLLIVTGALVGSSGAILSYIMCKAMNRSFVSVIAGGFGNDVQVSSSEEQGEHRETTAEEVAELLKNASSVIITPGYGMAVAQAQYPVADITAKLRERGVNVRFGIHPVAGRLPGHMNVLLAEAKVPYDVVLEMDEINDDFADTDVVLVIGANDTVNPAAMEDPNSPIAGMPVLEVWKAQNVIVFKRSMAVGYAGVQNPLFFKENTQMLFGDAKDRVEDILKAL

SEQ ID NO: 4168 - protein, 512 aa, H. influenzae strain 86-028NP
MLIGVPRELLENESRVAATPKTVQQILKLGFDVIVEHDAGFKASFEDQAFLEAGAKIGTSAEIWQSDIIFKVNAPTDEEIAQMKEGATLVSFIWRMQNPELMKKLTAKKINVLAMDAVPRISRAQALDALSSMANISGYRAVIEAAHEFGSFFTGQITAAGKVPPAKVLVIGAGVAGLAAIGAANSLGAIVRAFDSRPEVKEQVQSMGASFLEIDFKEEGGSGDGYAKVMSEEFNRRAMELYAEQAKEVDIIITTAAIPGKPAPRLITKEMVDSMKPGSVIVDLAAATGGNCEYTQAGKVVTTENQVKVIGYTDFPSRLPTQSSQLYGTNLVNLLKLLCKEKDGNINIDFEDVVLRGVTVVRDGEEIPPAQIQVSAQPKQETKAAPVAEKKESKPTDPRVKYGVMAGVGVLFLWLASVAPAAFLSHFTVFVLACVVGYYVVWNVSHALHTPLMAVTNAISGIIIVGALLQIRQPTGNLFIDALAFVAILVASINIFGGFRVTQRMLAMFRKG

SEQ ID NO: 4169 - protein, 821 aa, H. influenzae strain 86-028NP
MIMDNFDSPFQYNRPEMTVEAIKKSIVYKLIFLIGRSPREASQRDWLNATLHAVRDLVTEGWITTARQTRAEDSRRVYYLSMEFLIGRTLSNAMIAEGIYGLAQEALSELNVDLEEVLEKEVDPGLGNGGLGRLAACFMDSIATLGLPGMGYGIRYEYGMFRQKIENGQQVERPDAWLEKGAPWEFIRPSKRFTVEFGGNIHFEGKKCIWQDTEKVTALAYDQMIPGYQNNSAATLRLWSAHAGEVFNLADFNRGEHLAALEEHSANKNLSRVLYPDDSTWNGRELRLRQEYFLVSASLQDILRRHKRTHDSLENLADKVAIHLNDTHPALAIPELMRILVDDEGFEWKKAWEMTRNIFSYTCHTLMSEALETWPVEMMAKILPRHLQMIFEINDHFLEYVRTYVTTDNDFIRRVSLIEEGYQRKVRMGWLSVVGSHKINGVAEIHSDLMVTSTFADFARIFPERFTNVTNGITPRRWLAVANPQLAALFDKYIGSEWRCDLSQIEKLKPFTQEKAFKEAVADIKFANKVKLAEYVKRELGVELDPHALFDVQVKRIHEYKRQMLNVLHIIARYNEMLANPEKDWQPRVFILAGKAASAYYAAKQTIHLINDVANVINNDERLKGRLKVVFIPNYSVSLAQLIIPAADISEQISLAGTEASGTSNMKFALNGALTLGTLDGANVEILENVGENHIFIFGNTVEQVEQLRRDGYRSFEYYQNDAQLRTVVDQIIEGKFSPEEPQRYHQLLQGLQYHDYYQAFADFRSYVEIQKAVDEKYKQRDQWIESTIQNIVNMGFFSSDRTIKEYAERIWKVEPVQLGD

SEQ ID NO: 4170 - protein, 476 aa, H. influenzae strain 86-028NP
MKILHVCSELYPLLKTGGLADVLGALPQAQNQIGLDARVLLPAYPAIIAGIQNTQVVAEFDNFAGHVVLRYGEYNGVGIYLIDAPHLYGREGNPYHDAYYNDYGDNYKRFALLGWVGAELATGLDSWWRAEVVHAHDWHAGLCAAYLFNKGRPAKSVFTIHNLAYQGQFSYHHLYEIGLPTGMFHVEGLELFGQISYLKSGLFYSDASTAVSPTYAEEITTPEFAYGLQGLLSGLKAQGRLVGILNGVDENIWHPNVDQYIPHHYKLKYMAGKKKNKAELQAYFNLPQDESALAFVMVTRLTEQKGVDLLIESADEIVKQGGQLMILGSGAPHFEQGIRELAERYPQNIAVKIGYDEALSHLMVAGGDVILVPSRFEPCGLTQLYGLQYGTLPLVRKTGGLADTVVDSTSESIKARTATGFVFESATPEALRHCLQRAFALWQKPRAWAMVRTDAMEQDFSWRKAAEQYRTLYERL

SEQ ID NO: 4171 - protein, 444 aa, H. influenzae strain 86-028NP
MTNNNKTMEILMKSGDLNKYDLVKNTLVLVLAGGRGSRLHELTDKRAKPALYFGGNRRIIDFALSNCINSGLNRIGVVTQYAAHSLLRHLQTGWSFLPQERGEFVDMLPARQQIDDSTWYRGTADAVYQNMAIIKNHYRPKYILILAGDHIYKQDYSVMLMDHVNSGAKCTIGCIEVPRSEAHEFGVMAVNENLKVKAFVEKPKDPPAMVGKPDVSLTSMGIYVFDADYLYKMLDREVGTPNTSHDFGKDVLPKCLEEGALYAHPFSRSCMGRNTEGEIYWRDVGTLDSFWQSNIDLVSENPQLDIYDQSWPIRGNPVQAYPSKFFYKHSNVHPVDNSLIGGGCVITDASISNSVLFDRIKIDSFSKVDHCVVLPQVKIGKNCVLKNCIIDRECEIPDGMQIGVDMEEDKNRFRISSTGKVILVTPKMLKILEGHEIGEEGHLD

SEQ ID NO: 4172 - protein, 658 aa, H. influenzae strain 86-028NP
MFKIYNNGNPIPMGYSQAVENNVQITNFALFSAAAIGVELCLFDEQNQETRLPMVRTENVWHLAVTGVKTGTEYGFRIHGEFANPNKLMLDPYAKAVNGKPDLSSEESCSWFLLSDNRDNAHLAPRAVVISEDFNWENDTLPNTPWAETIVYELHVKGFSQLNEKIPAALRGTYTGLAHPVNLAYLKELGVTVVELLPVNFHINEPHLQARGLQNYWGYNPLAMFAVEPKYAATNNPLAEFKAMVKAFHNEGIEVILDVVFNHSAESEQTYPTFCQRGIDDQTYYWRNDQGRYINWTGCGNMLNLSSDVGRKWVVDCLRYWVEQCHIDGFRFDLASVLGRDTPDFNSSAQLFTDIKNEPSLQNIKLIAEPWDIGHYGYQVGNFPSYFAEWNDRFRDDLCRFWLWKSGEIGAFAERFAGSIDLFKKNDRLPHTTLNFITAHDGFTLKDLVSYNQKHNEANGEENHDGRNENYSYNHGVEGSTESLSEPQKSAVENNRTFAQSGLLMSLLLANGAPMLLAGDEFGNTQYGNNNAYCQDNEITWLKWANFNEELFELTKQTIALRKRMGSLNQDQWWSDENVQWLNIAGEPMTVEDWQNQQTKALQVVLDNRWLLLINAKAEGQVFHLPNGKWKPQIGTHNVTLEEQAELSSMGFCMLNDE

SEQ ID NO: 4173 - protein, 730 aa, H. influenzae strain 86-028NP
MTTAVTQATIDGFFDASNGDPFATLGMHETEQGIEIRTLLPDANRMVVIERESGKEITELDCVDERGFFVGVIPNCRQFFAYQLQVFWGNEAQIIEDPYRFHPMIDDLEQWLLSEGSMLRPYEVLGAHFMECDGVSGVNFRLWAPNARRVSIVGDFNYWDGRRHPMRFHPKSGVWELFLPKASLGQLYKFELIDCYGNLRLKADPYAFSSQLRPDTASQISALPNVVEMTEQRRQANQANQPISIYEVHLGSWRRNLENNFWLDYDQIADELIPYVKEMGFTHIEFLPLSEFPFDGSWGYQPLGLYSPTSRFGSPEAFRRLVKRAHEAGINVILDWVPGHFPSDTHGLVAFDGTALYEHEDPREGYHQDWNTLIYNYGRNEVKNFLSSNALYWLERFGVDGIRMDAVASMIYRDYSRAEGEWIPNQYGGRENLEAIEFLKHTNWKIHSEMAGAISIAEESTSFAGVTHPSEDGGLGFNFKWNMGWMNDTLAYMKLDPIYRQYHHNKMTFGMVYQYSENFVLPLSHDEVVHGKYSLLGKMPGDTWQKFANLRAYYGYMWGYPGKKLLFMGNEFAQGREWNYEESLDWFLLDENIGGGWHKGVLKLVKDLNQIYQKNRPLFELDNSPEGFDWLVVDDAANSVFAFERRSSNGERIIVVSNFTPVPRHNYRIGVNVAGKYEEILNTDSMYYEGSNVGNFGCVASEKIESHGRENSISVSIPPLATVYLRLKAK

SEQ ID NO: 4174 - protein, 699 aa, H. influenzae strain 86-028NP
VVSMQISDSLKQKAEKCGIALSHYDIDGHLIFADEKTVLTFVELLQPPPKAKGQFDDVLAAFENEPIDYRLNRLDLPPSAEYRYQLIDESNAILLEKILSNLSALSLPPLPFGYYQLSIFSDTEQYRVRLLISPKTAFQPSVLKNKKVWGVNVQLYSLRSEQNWGIGDFGDLAALIEQSAKQGADYVGINPLHLPYPAVPNWASPYSSSSRRWLNFLYLDIPDLPEFKRCRSVQNWFKREDIKAKIAALRESDCVDYSSILALKLTALESLFYFFQRSQSVEIVTRRKIFADYLKSKGEPLLLQGLFNVLDLQEHADHQAEENTIGWLGWRKEWQHLSAAKRKALLKIHHEQIQFFAWLQWLTEEQLSALQNLCKQSGMKLGIYGDLAVNSSRGSADVWSDPDLYCVNASIGAPPDPLGPVGQNWNLPPYNPTVLKARGFTPFIDMLRANMQYFGVLRIDHVMGLFRLWWIPKGKTAADGAYVHYPFDELMAILAIESVRNECLIIGEDLGTVPDEVRWKLNEFQIFSYFVLYFAQRNGEFPRISDYPRNAYATIGTHDVPSLQSFWHCRDLELFNQLGILNGEVLKQKYDQRVMDKQALLNSLHRDNYLPPHYEGDALSMAMHDYLNRMIHYYLAESNSRLIGVQLENLLSQEISSNLPGTSNEYPNWCKKLAQPLAFIFSNEALKTFFVQINQGRNV

SEQ ID NO: 4175 - protein, 154 aa, H. influenzae strain 86-028NP
MQSNMQLEPNFWQTKSLLEMTESEWEALCDGCGKCCYRKYIQGRSKRQKLYYTRIACNLLDVETGKCGNYSERFNIETDCTKLTKKNLPDFHWLPDTCAYRLLYEGKTLPEWHPLISGSPHSVKNADILIKNGIHERDVIDWFEFIIDEDHTFK

SEQ ID NO: 4176 - protein, 557 aa, H. influenzae strain 86-028NP
MMSHTETSLGAENTRTHNFITQIIDEDLASGKHKSVHTRFPPEPNGYLHIGHAKSICLNFGLAKEYQGLCNLRFDDTNPVKEDVEYVDSIKADVEWLGFKWEGEPRYASDYFDALYGYAAELIKKGLAYVDELSPDEMREYRGTLTEPGKNSPYRDRTIEENLALFEKMKNGEFAEGKASLRAKIDMASPFMVMRDPVIYRIKFASHHQTGDKWCIYPMYDFTHCISDAIERITHSICTLEFQDNRRLYDWVLENISIERPLPHQYEFSRLNLEGTLTSKRKLLKLVNDEIVDGWNDPRMPTISGLRRRGYTPASLREFCRRIGVTKQDNVVEYSALEACIREDLNENAPRAMAVIDPVRVVIENFESEAVLTAPNHPNRPELGERQLPFTKELYIDRADFREEANKQYKRLVLGKEVRLRNAYVIKAERVEKDANGEITTIFCTYDPETLGKNPADGRKVKGVIHWVSAVNNHPAEFRLYDRLFTVPNPGAEDDIESVLNPNSLVIKQGFVEQSLANAEAEKGYQFEREGYFCADSKDSRPEHLVFNLTVSLKEGF

SEQ ID NO: 4177 - protein, 491 aa, H. influenzae strain 86-028NP
MDAVELLMNVTPNETRIALVETGMLREVHIERQAKRGIVGNIYKGRVTRVLPGMQSAFVDIGLEKAAFLHAADIVSHTECVDENEQKQFKVKSISELVREGQDIVVQVVKEPLGTKGARLTTDITLPSRHLVFMPENSHVGVSQRIESEEERARLKALVEPFCDELGGFIIRTATEGASEEELRQDAEFLKRLWRKVLERKSKYPTKSKIYGEPALPQRILRDFIGTNLEKIRIDSKLCFGEVKEFTDEFMPELSDKLVLYSGNQPIFDVYGVENAIQTALDKRVNLKSGGYLIIEQTEAMTTIDINTGAFVGHRNLEETIFNTNIEATKAIAQQLQLRNLGGIIIIDFIDMQTDEHRNRVLQSLCDALSKDRMKTNVNGFTQLGLVEMTRKRTRESLEHVLCDECPTCHGRGRVKTVETVCYEIMREIIRVYHLFSSEQFVVYASPAVSEYLINEESHGLLPEVEMFIGKRVKVKTEQFYNQEQFDVVVM

SEQ ID NO: 4178 - protein, 504 aa, H. influenzae strain 86-028NP
MFGFDPSLITFTIYIFGMLLIGVLAYYYTNNLSDYILGGRRLGSFVTAMSAGASDMSGWLLMGLPGAVYLSGLVEGWIAIGLTIGAYFNWLLVAGRLRVYTELNNNALTLPEYFHNRFGSSHKLLKLVSATIILVFFTIYCASGVVAGAKLFQNIFSVEYSTALWYGAAATIAYTFIGGFLAVSWTDTIQATLMIFALILTPVFVLLSFADTAQFSAVLEQAEAAVNKDFTDLFTSTTPLGLLSLAAWGLGYFGQPHILARFMAADSVKSLIKARRISMGWMVLCLAGAIGIGLFAIPYFFANPAIAGTVNNEPEQVFIELAKLLFNPWIAGILLSAILAAVMSTLSAQLLISSSSITEDFYKGFIRPKASEKELVWLGRIMVLVIAALAIWIAQDENSKVLKLVEFAWAGFGSAFGPVVLFSLFWKRMTSSGAMAGMLVGAVTVFAWKEVVPADTDWFKVYEMIPGFAFASLAIIVISLLSNKPEQDILNTFDKAEKAYKEAK

SEQ ID NO: 4179 - protein, 321 aa, H. influenzae strain 86-028NP
MIDFRPFYQQIATTNLSDWLETLPLQLKEWETQTHGDYAKWSKIVDFLPDLHADEIDLKSAVKSDRTFPLSEGEKQRIIHHLKQLMPWRKGPYHLFGIHVDCEWRSDFKWDRVLPHLAPLQGRTILDVGCGSGYHMWRMVGEGAKMVVGIDPTELFLCQFEAVRKLLNNDRRANLIPLGIEQMQPLAAFDTVFSMGVLYHRKSPLDHLSQLKNQLVKGGELVLETLVVDGDVNTVLIPADRYAKMKNVYFIPSVAALINWLEKVGFTNVRCVDVATTTLEEQRKTDWLENESLIDFLDSNDHSKTIEGYQAPKRAVILANK

SEQ ID NO: 4180 - protein, 292 aa, H. influenzae strain 86-028NP
MQELIKRTLPQDDALNQAIVNELRSQNWAGFLNYSQVQQLCHNFELTPLKLAMHLLPLAASYSHTAISHFNVGAIAIGEQGDFYFGANQEFANSAIQQTIHAEQSAISHAWLRNERRISDMVVNYTPCGHCRQFMNELHGAEKISIHLPHSQNNPLHSYLPDAFGPKDLDIAAHLLAEENHDLVADHQDDLVNQAILAANQSHCPYSNSPHGIAILFKNGDVVTGRYAENAAFNPSLPALQTALNFAYLNDKKLSDIERIVMAEKALKLSHKTMAETLLSTLTSVELEYYSL

SEQ ID NO: 4181 - protein, 160 aa, H. influenzae strain 86-028NP
MSKTSIGLDKVQSAELADKLNELLATYQVFYTNVRGYHWNIKGVNFFALHAKFEEIYTNLVARVDEVAERILTLGYTPNNAYSQYLKISRIKEDIAVSEAQECLSGTLQGLKTLLDQQREILAFANNANDEGTASQMSDYIKEQEKLVWMFQAACQTCHN

SEQ ID NO: 4182 - protein, 412 aa, H. influenzae strain 86-028NP
MISQIDKAELLERFLHYVSFHTQSKPNAKHSPSSVGQMKLAMQLQKELIQLGLENVEVSKYAVVTAFLPANDPNLTKTIGLVAHLDTSPQCSGKNVRPEVIEEYRGGDIALGIGEEFISPVYYSFMQKLVGQTLIVTDGTTLLGADNKAGIAEIMTALSILQKENIPHCNIRVAFTPDEEIGLGIHYFPMEKFSCDWAYTIDGGEVGELEYENFNAATAKVRFFGRNIHTGYAKGKMLNALTLACEFQQVFPVDEVPEKTDGKAGFYHLEDFSGDIEQVELTYLIRDFDEQNFAQRKAFIKNQVEKFNAKKGLKKPIELEIQDSYQNMYDVVKNVPQSIELADRAMKAVGIKPNHKPIRGGTDGAFLASKGLACPNIFTGGYNFHSKHELVSLQGMENTVQVIIEMLKCKDL

SEQ ID NO: 4183 - protein, 381 aa, H. influenzae strain 86-028NP
VKLGRKPKLVENQPQNKPIIELRSIKKSYGSNTIINDFNLAINNGEFVTILGPSGCGKTTVLRLLAGLEELDSGSIILDGEDITNVPAEKRHINTVFQSYALFPHMTIFENVAFGLRMQKVPNEEIKPRVLEALRMVQLEEMADRKPTQLSGGQQQRIAIARAVVNKPKVLLLDESLSALDYKLRKQMQQELKMLQRQLGITFIFVTHDQEEAITMSDRIVLLRKGKIAQDGSPREIYEDPANLFVARFIGEINVFEATVIERKSEQVVLANVEGRICDIYTDMPVEKDQKLQVLLRPEDIVIEELDENEHSKAIIGHIIDRTYKGMTLESTVEFDHNGMRVLVSEFFNEDDPHMDHSIGQRVGITWHEGWEVVLNDEDNQ

SEQ ID NO: 4184 - protein, 286 aa, H. influenzae strain 86-028NP
MKIINNKFQKITVAIIFSWLIFFVLIPNLLVLAVSFLTRDGSNFYAFPITIENYTNLFNPLYAQVVWNSLSMSGIATIICLLIGYPFAFMMSKIHPKYRPLLLFLVVLPFWTNSLIRIYGMKVFLGVKGILNTMLIDMGILSAPIRILNTEIAVIIGLVYLLLPFMILPLYSAIEKLDNRLLEAARDLGANTFQRFFRVILPLTMPGIIAGCLLVLLPAMGMFYVADLLGGAKVLLVGNVIKSEFLISRNWPFGSAVSIGLTVLMALLIFVYYRANKLLNKKVELE

SEQ ID NO: 4185 - protein, 256 aa, H. influenzae strain 86-028NP
MSRLLRNAFMFVVYAYLYIPIIILVTNSFNKDRYGLSWKGFSWNWYERLFNNDTLIQAAIHSVTIAFFAATLATIVGGLTAIALYRYRFRGKQAVSGMLFIVMMSPDIVMAVSLLALFMVVGISLGFWSLLLAHVTFCLPYVTVTIFSRLNGFDSRMLEAAKDLGASEVTILRKIILPLALPAVVSGWLLSFTISLDDVVVSSFVSGVSYEILPLRIFSLVKTGVTPEVNALATIMIVLSLALVVLSQLITRKNNH

SEQ ID NO: 4186 - protein, 388 aa, H. influenzae strain 86-028NP
LTHNQGVFLCLSFGRWFFYDSLTGEQTKMKKFAGLITASFVAATLTACNDKDAKQETAKATAAANDTVYLYTWTEYVPDGLLDEFTKETGIKVIVSSLESNETMYAKLKTQGESGGYDVIAPSNYFVSKMAREGMLKELDHSKLPVLKELDPDWLNKPYDKGNKYSLPQLLGAPGIAFNTNTYKGEQFTSWADLWKPEFANKVQLLDDAREVFNIALLKIGQDPNTQDPAIIKQAYEELLKLRPNVLSFNSDNPANSFISGEVEVGQLWNGSVRIAKKEKAPLNMVFPKEGPVLWVDTLAIPVTAKNPEGAHKLINYMLGKKTAEKLTLAIGYPTSNIEAKKALPKEITEDPAIYPSADILKNSHWQDDVGDAIQFYEQYYQELKAAK

SEQ ID NO: 4187 - protein, 647 aa, H. influenzae strain 86-028NP
VALISLTNGYLSFSDAPLLDHAELHIEPNERVCLVGRNGAGKSTLLKIIAGDVLMDDGKIQYEKDLVVSRLEQDPPRNAQGNIFDYVAEGVGHLTDLLKEYHQISVQLEENYSDQILSQLEQVQDKLEHADGWRFENKINEVLLKLGLNPNTKLSALSGGWLRKAALARALVCDPDVLLLDEPTNHLDVEAIEWLENFLLDFQGSLVFISHDRSFIRKMATRIVDLDRGQLQSYLGNYDLYLTTKEENLRVEALQNELFDKRLAQEEVWIRQGIKARRTRNEGRVRALKAMREERRQRRDVMGIAKLQLDTSSRSGKIVFEMEDVSYEIAGKTLLKDFSTTILRGDKIALVGPNGCGKTTFIKLLLGEIQPTSGKIRCGTKLDIAYFDQYRADLDPEKTVMDNVADGKQDIEVNGVKRHVLGYLQEFLFPPKRAMTPVKALSGGERNRLLLAKLLLQPNNLLILDEPTNDLDVETLELLEEILTDYQGTLLIVSHDRQFIDNTATECYLFEGEGHLNKYVGGFFDAKQQQANFWASKAVEEQAKAKKSEPLKEESAVKNDRTSKPKSVKLSYKEQRELEQLPQLLEELETKITVLQAEIADPAFFQQAHDITDAKLKALADTEAELETAFLRWEELEEKKNLADGKA

SEQ ID NO: 4188 - protein, 461 aa, H. influenzae strain 86-028NP
MQKNEIKQSDMKPLIIDSSWTERFLPDPPREKDNRPPFRRDRGRILHSAAFRCLQAKTQIHAIGENDFYRTRLTHSLEVAQIGSSLVAQLKFLETFESLSQTLNIDKNELQKQLKPLLPSNDLIESLCFAHDIGHPPFGHGGETALNYMMAEQGGFEGNAQTFRILTKLEPYTENAGMNLTRRTLLGVVKYPALLGVASPQYAELNFSRNIDPRFVRIHDWIPGKGIFRDDLKMFNWLLENLSENDRTLFCQFKKVRENPAESLHTRFKSLDCSIMELADDIAYGVHDLEDAIVTGVVNPHQWQAAHVALKQIPSAWLHENIDSISQRLFSDKHFERKQAIGALVNFFITNVRWKLTANFDEPLLRYNAELPPEVIAALGVFKKFVWDYVIRNVDTQRIEYKGQRMLTEMFQIFESDPERLLPRNTENRWRNAPKEGKKRIICDYIAGMSDAHALRVYQQL

SEQ ID NO: 4189 - protein, 231 aa, H. influenzae strain 86-028NP
MQQYIIYLYTFLTIFGFWLALQISKRWKSMIFNTFVLTVLILAAILVIGKIPYDDYMAGNAPINNLLGLSIVALALPLYEQLRQIARQWKIILSTVVIASFLAMLSGGLLAFLLGATPEMVATVLPKSITMPIAMEVSRHLGGIPAVTAVGVVVAGLQGSIFGYLVLKKLGVKHQEAIGLSVGSVSHALGTVSCMETNPTAGSYSSISLVLCGIISSILAPFVFKLIYFFV

SEQ ID NO: 4190 - protein, 140 aa, H. influenzae strain 86-028NP
MIQKLFLLVRSLVILSIMLYLGNLIAYYIPSGVPGSIWGLLLLFLGLTTRVIHLNWIYLGASLLIRFMAVLFVPVSVGIIKYSDLLIEQINILLVPNIVSTCVTLLVIGFLGHYLYQMQSFTHKRKKVIKRRENQVKQAN

SEQ ID NO: 4191 - protein, 160 aa, H. influenzae strain 86-028NP
MINRKILLASLLLIFTVLSACSREKNTCRVVKISDGDTLTCLTKGNKSIKVRLAEIDAPEKSQAFGQKSKKTLSDLVYQKNVRLSLKGKDRYQRTFAIVYYQDKNINLEMVKQGMAWAYKQYSHDPIYLQAQENAQAKGIGLWADNNPIEPSQWRRQEKN

SEQ ID NO: 4192 - protein, 399 aa, H. influenzae strain 86-028NP
MAFDYQTFRQEFPYFQREDSVIYLDNAATALKPQVLIDRTAEFYASAGSVHRSQYDAAQTVQYEQARTQVKEWVHAEDKHAVIWTSGTTHAINLVANGLLPQLNAEDEILISQADHHANFVTWHETAKKCGAKIRVLPILDNWLIDENVLISTLSEKTKLVALNFVSNVTGTEQPIKRLIQLIRKHSHALVLVDAAQAISHIKIDLQDLDADFLAFSAHKIYGPNGLGVLTGKLTALSQLQPLFFGGKMVERVSNNRITFAELPYRLEAGTPNIAGVIGFNAVLDWLQKWDFTAAEQYAISLAESVKVRLKSYENCRLFNSPQASTVVCFVFDGIDCSDLSTLLSEQNIALRVGEHCAQPYLARLGERTTLRLSFAPYNTQKDVEAFFTALDKALDLLQ

SEQ ID NO: 4193 - protein, 126 aa, H. influenzae strain 86-028NP
MIEQLKQAKNWEDRYRLIIQAGKNLPRPSDNELAQMQPITGCEAQMWFQIMPKHDRTFQFSGFSEARIMNGLLWILFNQINGKTADELNTFDIIAFFSELGISQRLSEMRLNGLNQIRQQLKNLCI

SEQ ID NO: 4194 - protein, 265 aa, H. influenzae strain 86-028NP; identical to SEQ ID NO: 658

SEQ ID NO: 4195 - protein, 279 aa, H. influenzae strain 86-028NP
MNYQDNSLKSLKLGQKTEYASQYDRTLLQPVPRALNRDGLGITQNQPFTIGADIWTAYEISWLNEKGLPQVAIADIYLDYQSQNLIESKSFKLYLNSFNQSKFTDFNAVQQTMQRDLIECAQGDVKVRLNPVAVYDAQKIEHLQGDCIDEQDIEITSYEFNANWLKDCVSDEIVEEKLVSHLLKSNCLITNQPDWGTLHIHYVGKKINHEKLLRYVISFRQHNEFHEQCVERIFCDLMHYAKPEKLTVYARYTRRGGLDINPFRSNFENLPENLRLARQ

SEQ ID NO: 4196 - protein, 374 aa, H. influenzae strain 86-028NP
MEVLKDLRSEIDSLDRELIQLFAKRLELVSQVGKVKHQHGLPIYAPEREIAMLQARRLEAEKAGISADLIEDVLRRFMRESYANENQFGFKTINSDIHKIVIVGGYGKLGGLFARYLRASGYPISILDREDWAVAESILANADVVIVSVPINITLETIERLKPYLTENMLLADLTSVKREPLAKMLEVHSGAVLGLHPMFGADIASMAKQVVVRCDGRFPERYEWLLEQIQIWGAKIYQTNATEHDHNMTYIQALRHFSTFANGLHLSKQPINLANLLALSSPIYRLELAMIGRLFAQDAELYADIIMDKPENLAVIETLKQTYDEALTFFEKNDRQGFIDAFHKVRDWFGDYSEQFLKESRQLLQQANDLKQG

SEQ ID NO: 4197 - protein, 306 aa, H. influenzae strain 86-028NP
MSRPRKRWRDVDGVFLLDKPQGMSSNDIMQKVKRLFQANKAGHTGALDPLATGMLPICLGEATKFSQFLLDADKRYLVTAKLGERTDTSDAEGQVVETREVHVETPQILTALEQFRGDILQVPTMFSALKHNGKPLYEYARQGITVEREARPITIFELNFIEYHAPFLTLEVHCSKGTYIRTLVDDLGEVLGCGAHVTMLRRTAVADYPVAEMIPINELQLLAESFPLSELDRLLLPTDTAVSKLPALHLDVEQSKAIGFGQRVKFANEQQLGGQVRLFSAENLFLGVALIDGNIIRPQRLITQSA

SEQ ID NO: 4198 - protein, 128 aa, H. influenzae strain 86-028NP
MAREFKRSDRVAQEIQKEIAVILQREVKDPRIGMVTVSDVEVSSDLSYAKIFVTFLFDHDETAIEQGMKGLEKASPYIRSLLGKAMRLRIVPEIRFIYDQSLVEGMRMSNLVTNVVREDEKKHVEESN

SEQ ID NO: 4199 - protein, 556 aa, H. influenzae strain 86-028NP
MQARRDTKIVDENHTLQQAFLNDLDEKLWSSADKLRQQLDAANYKHIVLGLIFLKYISDNFTHQQEKIQAELSDAENPLYLDRTFFDTEEEYQEALTAELENRDYYTADNVFWVPASARWQALQEVSILNTGAELPWGGKFSGVAKLIDDAFDAIEKDNEKLKGVLQRISGYAVNEDTLRGLIILFSDTNFTRPTYNGEPVHLGAKDILGHVYEYFLGRFAQAEGKRGGQYFTPKSIVSLIVEMLEPYSGRVYDPAMGSGGFFVQTERFITAHQGNINNVSIYGQEFNPTTWKLAAMNMAIRGIDYDFGKHNADSFTQPQHIDKKMDFIMANPPFNISDWWSESLADDPRWAYGTPPKGNANFAWLQHMIYHLSPNGKMALLLANGSMSSQTNNEGEIRKAIINADLVECMVALPGQLFTNTQIPACIWFLNRNKKRKGEVLFIDARQIGYMKDRVLRDFTADDIAKIADTLHTWQKSDGYEDQAAFCKSATLEEIKDNDFVLTPGRYVGTAEQEDDGVPFAEKMQNLTALLKEQFAKSAELEAEIKKNLGGLGYE

SEQ ID NO: 4200 - protein, 421 aa, H. influenzae strain 86-028NP
MSKIPLNEFITLQRGFDLPSNKRISGSVPVVASTGIAGYHNEIKVKAPGVVIGRSGSIGGGQYIEKDFFPLNTTLYVKDFKGHYPRFIYYLLKSIDFTSFNVGTGVPTLNRNHLSSILISDLGIEKEKEIANILGSLDQKIQLNTQINQTLEQIAQALFKSWFVDFDPVRAKVQALSDGLSLEQAELAAIQAISGKTPEELTALSQTQPERYAELAETAKAFPCEMVEVDGVEVPKGWEVKALDEIANYQNGLALQKFRPEDDEPFLPVVKIAQLRQGYADGDEKAKANIKPECIIDNGDVIFSWSGSLLVDIWCGGKAALNQHLFKVSSKEYPKWFYYFYTKHHLTEFQRIAYDKAVTMGHIKREHLSAAKCIVPNDELLANKTLENILEKIIFNRLENFNLQNTRDLLLPRLLNGELNG

SEQ ID NO: 4201 - protein, 348 aa, H. influenzae strain 86-028NP
MDRTTDYLERLFIEELNSEGEIIISGNSFFRHEILYTLDPEAYKDVFEFWKTERKQRNLNEANRILDITSDNRNRFIRLKELFKEKKIIPFIGAGMSMSTGLPSWSEFLRSVQQETRTDRFYFEDLLSQGEFEEAAQYLDDCSPSHLQEQLDNIFGRKYLFNEINGVICLLPKFFNNTPIITTNYDNILSTVYQKCDYPFSDELNGLYLEDLYNKLLDKQNFLLKIHGTFDKPQNRILTKNDYDKHYNDQTSKLKNCVESLFSSSLLFIGCSLTIDRLIKALAEIVQEKGSENLPRHYAFLFSDPKKDVNRINKKEELAKSNIFPIWYDGDHDESIEALLELLNDGEQ

SEQ ID NO: 4202 - protein, 1055 aa, H. influenzae strain 86-028NP
MLNENDIEQLTLQRLQSLGWEYRYGKDLPVHEGEFSRGNLSGVVFIEQLREAVRKLNPQLPESAVDSVVKSATKSDIGDLVVRNQTFYKLLRDGVRVEYQDDGEQKIEMARLVDFEHGENNRFVAVNQLEIRSRKGGKRIPDIIGFVNGLPLVVFELKNPLRESADLLQAFNQFETYKDEIAELFVYNQALIISDGIAARLGSLSADFQRFTPWKVVDEKNKSVRLYFDDELQSLLNGLMQPEDLLDYIRYFVLFERDSVGKTIKKIAAYHQYYGVNEAVESTIFATSEQGDKRIGVMWHTQGSGKSISMLFYAGKLLAQPELKNPTIVVVTDRNDLDGQLFQTFSSGKDLIKQTPQQVEDRDQLRQLLAQNEVGGVFFTTIQKFALNEEESRFPILNERNNIIVISDEAHRSQYGFTQKLHNGKFQTGYARHLRDALPNASFIGFTGTPISLEDKDTQDVFGRYVSIYDLQDAVEDGATVPIVYEARQIKLAENANHDELFAEIDELLEGEENPKLRLREKLLGSEARLHDLAIDFVQHFAKRNEVVDSKAMMVVSSRQICVDLYNQIIALHPEWHSDNINEGAIKIVMTGSASDASEMQKHVYSKQEKQTLERRFKDPNDPLKVVIVRDMWLTGFDAPCCNTMYLDKPMKGHNLMQAIARVNRVFRNKSRENGGLIVDYVGIADELEKATRQYTNSQGKGKLADSVIDVFFKMKEHLEVIRSLFATPVEGKTFDVQAALEKDNPNDLLMAIRFAANHILSLDQLSFDGKAHEQHWFNKKETEPRKKAFLKTAGLVKKGYMLCGTLAEVEPYNQEIAFYDAVRAILTKREQKGTGTNERQILLKKLVNQTVYSEGVIDLFDLLEKPQPQISLLSEEFLQTVKNSPTKNLWVSAMERYLASEIKVKSGTNLTLQKDFERRLKEALNQYHNHNLTVVEILDELFKMSQDFQERLALGKKLGLTKEELAFYEALSQNQSAKDLMGDEVLSKLAKEITETLRKSVTIDWQYKEAVRARIRLLVRRALQKYKYPPDKQEEAVTYVIKQAEEIAEDLTGL

SEQ ID NO: 4203 - protein, 844 aa, H. influenzae strain 86-028NP
MTEDVKADAPKKLSIQRRTKTTVSSTTTGGKSKEVQVEVRKKRTVKTDIAQQEEAKLKAQQEAEAKKIAEQKAAEEKARLEAEKAATKKEADEKSKAEKAKAETAKPAKSAVDSKAKFVDPEKEKRKAEEAELRRKAEEVARQKAEEQARRAAEEAKRYAEADDSDNESSSEDYSDYNLSSRYALEAEDEEDRRNENRGRGKNKVAKAKKGGRDDENSKNSKNERESNRKNQKDAKFGKGKNGKKGTALQQAFTKPVQVVKADVVIGETITVAELANKMSVKATEIIKVMMKMGEMVTINQVIDQETAQLVAEELGHKVILRNENELEEAVLGDRDVNAEKVTRAPVVTIMGHVDHGKTSLLDYIRKAKVAAGEAGGITQHIGAYHVEMDDGKMITFLDTPGHAAFTSMRARGAKATDIVVLVVAADDGVMPQTIEAIQHAKAAGAPLVVAVNKIDKPEANPDRVEQELLQHDVISEKFGGDVQFVPVSAKKGTGVDDLLDAILLQSEVLELTAVKDGMASGVVIESYLDKGRGPVATILVQSGTLRKGDIVLCGFEYGRARAMRDENGKEVDEAGPSIPVELLGLSGVPAAGDEATVVRDEKKAREVALYRQGKFREVKLARQQKAKLENMFSNMSEGDVAELNVIVKADVQGSVEAIVQALNELSTNEVKVKVVGSGVGGITETDATLATASNAIIVGFNVRADATARRVIEAENIDLRYYSIIYELLNEIKAAMSGMLEPEFKQEIIGLAEVRDVFRHPKFGAIAGCMVTEGVVKRNNPIRVLRDNVVIFEGELESLRRFKDDVSEVRNGMECGIGVKNYNDVKVGDQIEVFEVVEVKRSI

SEQ ID NO: 4204 - protein, 495 aa, H. influenzae strain 86-028NP
MSKEILLAAEAVSNEKLLPREKIFEALESAIAISTKKKFEYETDIRVSINPKTGEFDTFRRWLVVDEVKVPTKEITLEAAQFDDPNLQLGEYVEDQIESIAFDRIAMQTARQVISTKIREAERAKVVEQFREEEGKIVTGTVKKVSRDSIILDLGNKAEAMIAREDMLPRENFRPGDRVRGVLYKVNPEGKTAQLFVTRSKPEMLIELFRIEVPEIGEEMIEIRGAARDAGSRAKIAVKSNDKRIDPVGACVGMRGARVQAITNELGGERVDIVLWDDNPAQFVINAMAPADVSSIIVDEDNHSMDIAVEADNLAQAIGRNGQNVRLATQLTGWTLNVMTTDELNAKHQAEDNKVLNLFINALELDEEFAQILVEEGFTSLEEIAYVPMNELTAIDGLEDEDLVEELQTRAKNAITAAAVAEEEALKKANVEDRLLNLEGMNRHVAIKLAEKQITTLEELAEQGVDDLTDIEELTAEQAADLIMAARNICWFGEE

SEQ ID NO: 4205 - protein, 151 aa, H. influenzae strain 86-028NP
LATLEQNLQEMLQDAVKDLGCELWGIECQRVGRFMTVRLFIDKEGGVTVDDCADVSRQVSAILDVEDPIADKYNLEVSSPGLDRPLFTLPQFERYIGQDIAVHLRIPVMERRKWQGKLERIEKDMITLIVDDQEQILVFGNIQKANVVAKF

SEQ ID NO: 4206 - protein, 254 aa, H. influenzae strain 86-028NP
MGWGGILGAMTQGLGTGIVKNVEQGWKDEETQKLLDWKTAEADKQRAFDSELLDKKYKHEFELEDHRTRNEISAAAAKARISARYSHGGESEAQKNLLGATQTLGIYDSQLHSLQEKLSATEDKEQQNAIAARINAVSAERENYLKRPDTIAAFKGAGQMGQALYMTGGGNMDLYNPKPVERETVAEDVKSSVAPPVRNMIDVNNLTPQQAADIARQKSEDAARLQFSKASADAKDWAQKRTQYQSSTFIPRTF

SEQ ID NO: 4207 - protein, 175 aa, H. influenzae strain 86-028NP
MGILDSMTQQSQPQTTEQSAVENPQGSQQQGSMAQMYQMLMQNSINAIANVAQQRIQEKGPEEGIADLVAKAMISNLQAAQQNGKTIPPQVMMQVAKDLAMQLLQQVGVPEEQIDDVLIDILMNALEQFGEATHGALPQEEEQQYVDMINKVSEMESQRRAQVQNGQSKPMQQGA

SEQ ID NO: 4208 - protein, 379 aa, H. influenzae strain 86-028NP
MEKAGYERASDSDSSFSGGGGWREDNSSDSYRSTSDRWNDHKSRYGKDKVYTDAFNERRNNSSWSGGHSAISRTISEKYHSLSNGQMSAAVPEKDQKTLTGGLFGKSYSNAPYSERTPSIFDRNIRGSMTLNNGDVWSSDPQYSSVRERADINSYDRIKRGEELNLIGRAVGGVFSGVGGAATTPVGKIAESAANFGLSHVGDLSRQFKSNQEQAYYDSLTPEGKAYYDTRVDFINKSYKNAREKYETNDKWIDRGITAAQVGLSALGPPGAMLGSGIGLLGKAINKKDTMTKSLRDLTETLNSNALNNHIAQQNELAEKERQAYKEFMAGRDLRSDNTQPKGILNTMYNRMQNIDPDKQVKTSDVPNLRNYWANIIVS

SEQ ID NO: 4209 - protein, 122 aa, H. influenzae strain 86-028NP
MAFWDGAWDAISGAGKWLGETAGSAMDWMDNHKAASNIIGNVIAGAGGYFAQKQAGKDLINQQRELLNLQDQMKSKYSAVPDADWSYKSLTVDDSPGLANGGILTEMKKRSETKGANNGRVA

SEQ ID NO: 4210 - protein, 273 aa, H. influenzae strain 86-028NP
MSILGSMTDAVNKTKTPQAPTISTQSPTKDTSQTMAGNVSNLLNSNSLLMNSAAAKGERMAANRGLQNSTIGVESAQRAMLDAAIPIASQDTQNAFAEKQTRLQADLNFQNQSKLNQQQNQFTASQAELERGHQRGMAQLQSDLAYSNQSRLNQAQNQFTASQAALERQQQKDMANLNHQNEMKNLNAQVAANTIGKSIDFTMQITNNFDAQIATILNNSNMKAEDKTKAIEQLKASRDSEIQFMSKFMQGIPTTQQNWSSFPSLGVPSIQIS

SEQ ID NO: 4211 - protein, 167 aa, H. influenzae strain 86-028NP
MIGTKIYLALYKGKKTGKNPNALLARLSDWLTRKLTKGVYSHCEIAVMKEVFVSGHHYETEVMYECYSSSIRDGGVRCKQIDVYDREKWDLIPLDGVTEAQIKAYFDRTLGCKYDWWGAVGIVLGIKQKRSKYFCSEWCFNCIKNSNEGWRFSPNQLAVAFTTVSNN

SEQ ID NO: 4212 - protein, 200 aa, H. influenzae strain 86-028NP
MKVYFLKENLNSYQIFPIPQNLNDFVEMEVENESELETKQLIYFKSQYILVDRQPTELHKWNGNSWIVDEKKKTEIKRELIKNLVDSIDDTAANISSRWIRFAEEYKEREAAAIAFKEANFAGEVSVYISSFATVAGLDNQSASLLILQQAERLRALQQQLAVQRMRKYELKHEALSDEELKNIHDDIVSKMRQLAEAQQ

SEQ ID NO: 4213 - protein, 840 aa, H. influenzae strain 86-028NP
MASQYFAILTDYGTRAIAHALSQGQPLQLTQFAVGDGNGKAVTPTANATALVHQTHIAPVSAVSLDPRNNKQVIVELTIPENIGGFYIREMGVFDAQNKLIAYANCPESFKPTESSGSGKVQVLRMILKVESSSAVTLSIDNSVIFVTRQQMTPKTITATTQNGFNESGHSHQIAKASTTQQGIVQLTNDTGLESESLALTAKAGKKLAQQTTQLQLNVSQNYIQNSKKSSAVNSESEDNVATSKAAKTAYDKAVEAKTTADGKVGLNGNESINGEKSFENRIVAKRNIRISDSQHYASRGDYLNIGANNGDCWFEYKSSNREIGTLRMHANGDLTYKRQKIYHAGAKPQFNTDIEGKPNTLAGYGIGNFKVEQGQGDANGYKTDGNYYLASGQNLPENGEWHIEVVSGGATNAVRQIARKANDNKIKTRFFNGSSWSEWKDAGGDGVPIGAVVSFPRAVTNPVGFLRADGSTFSQQTFPDLYRTLGNSNKLPDLTRSDVGMTAYFAVDNIPAGWIAFDEIATQVTEQRYPELYRHLVGKYGSISNVPLAEDRFIRNTGNGLNIGQTQSDEIKKHVHRVRTHWADSSDSSIFYDKTKTVIDSRLCTATTTDDNLSDNGFMHPLLDTPMATGGDETRPKSLILKLCIKAKNTFDDVQFWVKAFGVVENAGILDAGTLVQNMQALSARVDQEIKENKQSTLQEINNAKVDINQQFLQAQKNLSQIGTLKTVWQGNVSSGSINISEKCFGKTLILYLQSSSGHRLDDNNNIEIVSFEVGAEIEGKRGGGVYFSSIRQVIPHSSGGTSVYHVEVEEFAVTVDRNGTTIHIEELAGRFVKRIDIR

SEQ ID NO: 4214 - protein, 178 aa, H. influenzae strain 86-028NP
MITNHLLPIGATPLEKRAAEILKSAVENPIVIADLINPERCPTELLPYLAWAFSVDKWDENWTEEVKRIAIKQSYFVHKHKGTIGAVKRVVEPIGYLIELKEWFQTNPQGTPGTFSLTVEVSESGLNEQTYNELVRLINDVKPVSRHLNQLAIALSPTGSLCAFVGQQWGEIITVYPQ

SEQ ID NO: 4215 - protein, 304 aa, H. influenzae strain 86-028NP
MSELVDLSKLDAPKVLEDLDFESLLADRKAEFIALFPQDERAFWQARLSLESEPITKLLQEVVYLQLMERNRINNAAKATMLAYASGSDLDVIAANYNVKRQVIQEANNNVTPKIPEILEDDTSLRLRTQLAFEGLSVAGPRSAYIFHALSAHPDVADVSVVSPQPANVTVTILSRNGQGETNENLLNVVRAKLNDDDIRPIGDRVIVQSAVIQSYEIRAKLHLYRGPEYEPIKAAALKKLTTYTEEKHRLGRDISLSGIYAALHLEGVQRVELISPTADLVLPSSKSAYCTAINLEIVTSDDY

SEQ ID NO: 4216 - protein, 112 aa, H. influenzae strain 86-028NP
MNRYTGETLKNESDHIKQSIADILLTPVGSRIQRREYGSLIPMLIDRPISHTLLLQLAACAVTAINRWEPRVQITQFKPELVEGGIVASYVARSRKDNQEMHNEKLFLGHKQ

SEQ ID NO: 4217 - protein, 199 aa, H. influenzae strain 86-028NP
MPMSAELQRKLDNIIRFGVIAEVNHATARARVKSGDILTDFLPFVTFRAGTTKTWSPPTVGEQCVMLSVSGEFTTACILVGLYTQNSPSQSPDEHVIEFADGAKITYNQSSGALVVTGIKTASITAANQIDIDCPAINIKGNVNIDGSLSTTGTSTTKGNISTQGSVTASGDIKGGSISLQNHVHLEQGDGQRTSNAKA

SEQ ID NO: 4218 - protein, 142 aa, H. influenzae strain 86-028NP
MKIELSKQFQEGRLNTPFFKDIQAMSDEELQLIFDFMQSIKQGKLLRGKNKPSWLDDNLNDIPNTEVYQQNEIWHYHCGPYNKGSRYCPMSGLKINLNGETSGPVIHYQKISDEHIVIIAFSPQHEPFPREWDTPNPIIDRA

SEQ ID NO: 4219 - protein, 185 aa, H. influenzae strain 86-028NP
MTNLSLNPIFESFAPIFKQLKTVAMSALFIAPLAINHPVRHTTHTVNIFSVQTDENKSINQQDIEKIIDMVKAVSAITDFVIASITAESLSYIDLSDVLRLESKINKYDDLANNIMVNNKTPELSTTLQSFSNKMHTLCNMMKSEKYKQQSDEVVLSRLYRKSEDAGYTYKSSHSFDDFKKAVMM

SEQ ID NO: 4220 - protein, 150 aa, H. influenzae strain 86-028NP
MLERKHIKFVEIHHLFTQISLALGFTEQDIDKHSTNLAELIALWQQQEFVEVYVENKDRLFGRAKDSSLAYGASPYYIGLYHARLSYEENDPLVVLTFNYEDNPEQTTVSVRFMVDHDTLFGTKEEKFIQQRMKDIRKRIDDFIQLGNKK

SEQ ID NO: 4221 - protein, 66 aa, H. influenzae strain 86-028NP
VLGSAKNRRVSMNENAPFIREIIDRTSQIKGERVKGDNAKEIKANVQTILKAQLRATQLNARTQTY

SEQ ID NO: 4222 - protein, 654 aa, H. influenzae strain 86-028NP
MVTAAARMDIQENELEDFIRLNTQMATAFDAENPDELVELFGKVQKNFKLTTKDAKELADTINYLDDNAISKGTDIINFLNNTSGIGNLVKISEKNLAALGSTLLTAGNEASTSAKAIESTFNRLSKATRMKPVNNGLKALGLDPKAIQKAMVKDAQGTLMMIVEKIKKLPKHLQAGVISDIAGGNYNTQLAGLVANTEEWRRQIELANSEEAKNSMAREFQTRMTTLSAKWQLFKNRLFNVNSSVGASLKDSMTSLMDGVGNLLDKIETWIDEHPKLTSTIAKTAVAIGGSLSLLGALSLALSFILYPAARLFLGLSKLNVIIPKFSGHLSSAGRLILRGLLSPLKLIALAISPLGIALLSVAALIYKFWQPIKAFFGGFWEGLKSGLAPVLEKFQPLGTAFGVVVGWIEKAVKWFTDLLSPVQSTKEDLDAAVSAGERFGNGMAKAIEFILTPLTRLMDGIKWISENMPSWEGIKNSVSSAWERTKNTSSNAWQSTKETAGSAWESFKDFTGFGSNGKKLPSQNWSGGYTGNGGKYEPMGIVHGGEYVMTKEATSRLGVNTLNALNYGKRALIAGGLGISVATAAPVQVDTRAPIFARPMMTQTSQPMSVNITINAAQGMDERAIAQQVAKQIQRIENQRQARARSSMWDRA

SEQ ID NO: 4223 - protein, 255 aa, H. influenzae strain 86-028NP
MKNLELTVLLNAIDKISAPVRSASKSVHELSAKLKESKSIHRQLNQQNKQHQAAMKQYASAINPLKSKLDSLNQELEQAKQKAASYAQYMKNAQHPTAGFQKEVEKAKSAVKKLKQEQIDAANKLQQARQELAKSGISAEKLAQKQRELQKNTKSATDQIKNQEAALKKLNAKQAAYNQYRGQVEKLKDISGKAQIIGAQATAAGTTMTAPIVNSIRDFMSFEDVMAGVARQVPGLKDKFGQFTPKYDEWKNKIK

SEQ ID NO: 4224 - protein, 112 aa, H. influenzae strain 86-028NP
MNKLNRERTMEIFVLLIGLPIIVGLLIAFGTAVLAAFSYIFVGALSLAINFWYITLAVMLVLLAPLIYLNSWLFWILAALVIFFTVAWFFGGDTEQIKAEIERKRIAKEHKL

SEQ ID NO: 4225 - protein, 60 aa, H. influenzae strain 86-028NP
MPLIKCLLQFAVHQYGLTARPSNNKDFKVQYAQRELLGFAEEDIEMIERFVLRAIAGKEF

SEQ ID NO: 4226 - protein, 115 aa, H. influenzae strain 86-028NP
MKNKRTSRTLIMLNIAMWSLVIISTCLHYQFNPFSFIWFDVIAPVGHFFAVVFSALSSFTVSMYELFKPETFWGWVWFVMFVVPIICLPLYVVLLVLFAGKLSHHDTVVPPSYLK

SEQ ID NO: 4227 - protein, 153 aa, H. influenzae strain 86-028NP
MATVEEVQAKLTALIANLSPQARRQLGRKIGQALRKSQSNRIARQQNPDGSAFEPRKPRKEFGKKKGRIKRKAMFAKLRTARHLKVRSNGNEVSVGFNGSSAAIAAVHQYGLTARPSKEKDFKVRYAQRELLGISEQDLSMLNELVIEQISKS

SEQ ID NO: 4228 - protein, 128 aa, H. influenzae strain 86-028NP
VDGGQIVATGAASFSFEYRYTLNVVVTDYAGDIATLIVPMMAYLRTNQPEILENPQIRENAFKFQIDYNNNNTADISFEIQLTERVVSKKDGNNVQIHYAKEPVWDEPNRVKVYLENRDSPIFEGDTV

SEQ ID NO: 4229 - protein, 35 aa, H. influenzae strain 86-028NP
MTDTGHLIVAVDKDNRPLICRDTQNEKAQPTAQNP

SEQ ID NO: 4230 - protein, 40 aa, H. influenzae strain 86-028NP
MRRTTLFLAIAAALPCLANTYTVPFRDGPFVNIQIILTEE

SEQ ID NO: 4231 - protein, 71 aa, H. influenzae strain 86-028NP
MTDQFDRAQQLEEMQREIALKKHRTFKAVSRLYCEDCDAPIPEKRRQMIQGVTRCVTCQQRFEIQQRNFRK

SEQ ID NO: 4232 - protein, 116 aa, H. influenzae strain 86-028NP
MFNFLTAKERGIFLIGPILLVLLIVFLGFKANYWRKEMLKEEQLKLKWQNAYIELNHSVQNFAEQQAQLIQAVNNLKANQNQQTQDLKNVLKSNQDWANRPLPDDVKRVLNSAGSH

SEQ ID NO: 4233 - protein, 172 aa, H. influenzae strain 86-028NP
MIKRSAKYICAISAVVGLVIASHGNEIRTSEKGLLLIGNAEGCMKKPYQCPADVLTVGIGITDAVEKIDRNKIYTLQEIAELYVKGIKQSEKCVNQYANGKTMPQGAFDALVSITFNVGCGKLKNSSLFKMARQGYSKAMCGQFERWIYAAGKPLKGLIERRQKEKNLCLIS

SEQ ID NO: 4234 - protein, 73 aa, H. influenzae strain 86-028NP
MHDAPSKASYTSGIFAFLIGRIADMFSNVNWADVASITGIVIGVATFLVNWYYKKKDFELKEKELKQRIHHHD

SEQ ID NO: 4235 - protein, 69 aa, H. influenzae strain 86-028NP
MQVYAQQNDNLDAILYRHFGRSEGLLEITCELNPHLMDKPIIPIGTPVILPDADTEKISVANDTIQLWS

SEQ ID NO: 4236 - protein, 168 aa, H. influenzae strain 86-028NP
MSDGAISVKLAPDYEMGEVQQQLNDYDTSDDIISNDGFFPDMSLSQFRNQYRADGTITTQRLQDALIEGMASVNAELSTFKTQSKRDSLEQIIAPSINGESVLIYRYKRAVSCLALANLYERYASYDSTNDGEKKMAQLKDSIDELRRDARFAISDILGRKRVDAELI

SEQ ID NO: 4237 - protein, 216 aa, H. influenzae strain 86-028NP
MRPTKRHFLEVSAAIANAAETEDLSDFTEYEKMCRILARHRKDLKNIQSTERKGAFKKQILPDYLPWIEGALSVGSGKQDNVLMTWCVWAIDCGEYHLALQIADYAVFHDLRLPEPFTRTLGTLLAEEFADQAKAAQAANKPFEVAYLEQVQRITADCDMPDESRARLLRELGLLLVEKHPEQALAYLERALGLDQKIGVKGDIKKLKKQLSATEC

SEQ ID NO: 4238 - protein, 349 aa, H. influenzae strain 86-028NP
MNKFTKQKFNTYLAGVAQDNGEDVAFIANGGQFTVEPTIQQKLENAVLESSDFLKRINVVMVQEMKGSALRLGVLSPVASRTDTNTKARETTDIHSLQENTYSCEQTNFDTHLNYPTLDSWAKFPDFAARVGKLKAERIALDRIMIGWNGTSAATTTNRTSNPLLQDVNKGWLVQIEDKAKARVLKEIEESSGKIEIGAGKTYKNLDALVFALKEDFIPAQYRDDTKLVAIMGSDLLADKYFPLINQEKPSEILAGDTVISQKRVGGLQAVSVPFFPKGTVLVTSLDNLSIYVQEGKVRRHLKDVPERNRVEDYLSSNEAYVVENYEAVAMAKNITILEAPTPISPVAA

SEQ ID NO: 4239 - protein, 271 aa, H. influenzae strain 86-028NP
MAKKSKWVVVATEGATTDGRTIQRNWISEMAANYDPKKYGARVNLEHIKWRYMWNDDPHSKCYGDVIGLKTEENAEGKLQLLAQIDPTDDLIKLNKDRQKIYTSIECDPNFADTGEAYLVGLAVTDNPASLGTEMLVFSAGASANPLNNRKEKADNIFTAAVETELEFVEETQSIFEKIKGLFAKKEKSDDERFSDQTQAIELLAEQTKETLEKLTALSDDLAKQKAEIEEMKASNAEIQATFAELQKPVEPENPRPLVYGEQPETDGRFF

SEQ ID NO: 4240 - protein, 593 aa, H. influenzae strain 86-028NP
MDEQVINQPSPEVTVEIKRKAQQMYFSGYKIAEISRQLNTPASTIASWKDREKWDDIAPVGRVELALETRLNLLIAKEEKSGSDYKEIDLLGRQMERMARVKKYSFGDGNEVDLNPKLANRNKGERKKAEPNAIDQEQEELLINGFLDGMFNYQRIWHKAKEHRIRNILKSRQIGATYYFAHEAFIDALTTGHNQIFLSASKKQALQFRSYIVNYAKQTADVDLKGETIKLPNGAELIFLGTNSATAQSYHGNLYFDEVFWVPKFDVMRKVASGMAAQKMYRQTYFSTPTTIAHPAYAFFSGKAFNRNRAKSEKIEIDISHENLKSGKLCADRQWKQIVSIYDAMESGCNLFNIDDLIAENSKEEFEQLFLCQFADDNSSAFKFSDLQLCQVDSLEEWHDYKPFYQRPFGNREVWLGYDPAFTGDRAALVIVAPPKVEGGDYRVLHKQTFHGMDYETQASRIKQFCDDYNVTRIVIDKTGMGSGVYQEVRKFYPMAQGLEYNADLKNEMVLKTQNLIQKRRLKFDSGDNDIVSSFMTVKKRITGTGKITYVSDRSEDASHGDLSWAIMNCILNVPYGLGGDVSSNKSTIFTFE

SEQ ID NO: 4241 - protein, 336 aa, H. influenzae strain 86-028NP
MSKKTKKSTALSTGNQAQAFSFGEPIPVIDRAEVLNYFESVVMYEKYYNPPINLSYLAKALNASAHHNSAITVKKNILLSTCKTTALLPRTQLEKLVQDYLVFGNAYVEKTVNSFGKVVSLKSSLAKYMRVGVETGVFYQIVNGFDEYEFKKGSVFNLINPDVNQEIYGVPEYLAALQSAFLNESATLFRCKYYLNGAHAGSIIYMTDPTQNKDDIEAIKTQIRQTKGTGNFKNLFVYIPNGKKDGMQVIPLSDAIAKDDFLNIKNASRDDVLAAHRVPPQLMGIVPNNTGGFGDVEKATRVFFINEIIPLQERLKEINSWIGEEVITFSDYKLLN

SEQ ID NO: 4242 - protein, 224 aa, H. influenzae strain 86-028NP
MTRIAIIPARAGSKGIKDKNLQLVGGVSLVGRAILAAQESGMFDQIVVTSDGENILKEATKYGAKPVARPESLAQSDTRTIDAILHCLETLNISQGTAALLQPTSPLRNALDIRNAMEIFLGGKYKSVVSACECEHHPYKSFTLEGTEVQPIHELTDFEAPRQKLPKSYRANGAIYINDIESLFEEKRFFIAPMRFYLMPTYRSIDIDSTLDLQLAESLISKEF

SEQ ID NO: 4243 - protein, 220 aa, H. influenzae strain 86-028NP
MTQLTREQVLELFHQRSSTRYYDPAKKISDEDFECILECGRLSPSSVGSEPWKFLVIQNKTLREKMKPFSWGMINQLDNCSHLVVILAKKNARYDSPFFVDVMARKGLNAEQQQAALAKYKALQEEDMKLLENDRTLFDWCSKQTYIALANMLTGASALGIDSCPIEGFHYDKMNECLAEEGLFDPQEYAVSVAATFGYRSRDIAKKSRKGLDEVVRWVG

SEQ ID NO: 4244 - protein, 386 aa, H. influenzae strain 86-028NP
VIKYVRQIYSTKQEVIMATYFSDNLTADQQNQVQQIIQQFQHPTLQKDLIVLNTLKKVEKGGDTLRIELKLPFAWNSGAEQLKQAVSDALLKATDCKSIKWAVAYQIATLKRANNQPAVKGVKNIIAVSSGKGGVGKSSVSVNLALALQAQGARVGILDADIYGPSIPHMLGAANQRPTSPDNQHITPIKAHGLSANSIGFLMNEDSATIWRGPMASSALSQLLNETLWDSLDYLVIDMPPGTGDIQLTLSQQIPVTGAVVVTTPQDIALLDAVKGISMFERVSVPVLGIVENMSMHICSKCGHHEAIFGTGGAEKMAEKYNVKVLAQLPLHIRIREDLDAGNPTVVRVPENEISQAFLQLAEKVSTELYWQGSVIPSEILFKEVK

SEQ ID NO: 4245 - protein, 682 aa, H. influenzae strain 86-028NP
MTTQPRKILVTCALPYANGAIHLGHMLEHIQADIWVRFQRMRGNKIHFVCADDAHGTPIMLNADKLGITPEELIAKAKADHIRDFAGFNISFDNYHSTHSEENKQLTAEIYNKLKANGFIKSKVISQLFDPEKNMFLPDRFVKGTCPKCKAEDQYGDNCEVCASTYSPMDLINPRSAVSGTTPIVKESEHFFFDLPAFEGMLKEWTRSGSLQSEIANKMQEWFESGLQQWDISRDAPYFGFEIPGAKDKFFYVWLDAPIGYMASFKNLCEREGIDFNEFWAEGSDAELYHFIGKDIVYFHSLFWPAMLEGSGYRKPTNVFAHGYVTVDGAKMSKSRGTFIQASTYLNHIDPECLRYYYAAKLNDRIEDLDFNLEDFVQRVNTDIVNKLVNLASRNAGFIAKRFEGKLSDKLEDEALFAEFTAQAEQIAAYYESREYNKAIREIMALTDKANKYIDEKAPWVIAKEEGKEAELQAVCSMGIELFRVLMSYLKPVLPKLAERAEAFLQAELRWDNIHQPLLGHTLAPFKALFSRLEKKQIDAVVEETKALFAAANKAAEKTEAKPTALSAVKPIAETITIDDLAKLDMRVAKVLKCEAVPESNKLLRFELDLGDHTRQVFSGIKAAYNKPEELEGRFVIMVANLAPRQMKFGVSEGMILSAGTGGSDLFLLSADNGVTAGMQVK

SEQ ID NO: 4246 - protein, 286 aa, H. influenzae strain 86-028NP
MKNELICYKQMPVWTKDKLPQMFQEKHNTKVGTWGKLTVLKGKLKFYELTENGDVIAEHIFTPESHIPFVEPQAWHRVEALSDDLECTLGFYCKKEDYFSKKYNMTAIHGDVVDAAKIISPCKVLDLGCGQGRNSLYLSLLGYDVTSWDHNENSIAFLNETKEKENLNISTALYDINAANIQENYDFIVSTVVFMFLNRERVPSIIKNMQEHTNVGGYNLIVAAMSTDDVPCPLPFSFTFAENELKEYYKDWEFLEYNENMGELHKTDENGNRIKMKFATMLARKK

SEQ ID NO: 4247 - protein, 233 aa, H. influenzae strain 86-028NP
MLFALPALNDNYIWLYQRENLPLIIVDLPETDKLFAWLDKQNATIEAVLLTHEHEDHTQGVSAFKKRYPTVPIYGPQECEKKGATQVVNEGKILTAHYQIDVIPTGGHTKQHVSFLVDNHLFCGDALFSAGCGRVFTGNYAQMFDGLQRLNTLPDETIVCPAHEYTLGNLAFAETVLVEKSAVEKQRIFVETQRAENKPSLPTTLKLEREINPFLQAKTLEEFTALRKAKDIF

SEQ ID NO: 4248 - protein, 268 aa, H. influenzae strain 86-028NP
MTIYDINFAELYQQHLIACHHYNLPPTKWDKKAVKMAENLVGKPSAYNQQLLQAMNVQTDETVLDIGCGPGTFAVPLAQQGSTVYALDYSNGMLDCLAQFKQKLGLHNLTTFHKSWTDNWDDVPQADVVLASHSTLVDDLDDMIEKLCAKAKKRVFLTSVTQRHFLDEGVFEAIGREDIGFPTYIYLLNRLYQKGIQANLNFIETESGCFQGEIYEDLLASVEFSLGELSEKEKQGLKAFYDRKQANNELIFHGQKKWALIWWNVDRI

SEQ ID NO: 4249 - protein, 158 aa, H. influenzae strain 86-028NP
MKFEVIYKFFLVWGLALSLLFVVASGISMWLGFPFSQALDIHLFFAGFTVFGLLLHFYSRKKKWVKINTQFADLITNNRMPSYCNLDRLMMTFEHFSIQQIAEQLNLSLPILLNELSQAQINITDSHRTLCENFPLNDEKIFAAITIALKVRFNPTLL

SEQ ID NO: 4250 - protein, 587 aa, H. influenzae strain 86-028NP
MTEQTFILGKDAALEDSIAKFQQKLTALGFNIEEASWLNPVPNVWSVHIRDKDCPQCFSNGKGASKKAALASALGEYFERLSTNYFFADFYLGQEIANGDFVHYPNEKWFPIEDDALLPNGILDDYLLDYFDPNAELTPELLIDLQSGNYDRGIVAMPYVRQSDEQTVYIPQSIIANLYVSNGMSAGNTKFEARVQGLSEVFERYVKNKIIAEAISLPEIPKSVMDRYPSIQASIAKLEEEGFLIYAFDASLGGKYPVICVVLLNPNNGTCFASFGAHPNFQVALERTVTELLQGRSLKDLDVFSPPSFNNDDVAEHANLETHFIDSSGLISWDLLKKTPDYEFADWDFSGTTQEEYNNLMAIFRADEKEVYVMDYNHLDVYACRIIVPGMSDIYPADDLIYANNNMGMDWREILLDLPNWHHDAETYQELLDELDGQDIDDATRVREFIGIVAPKNSGWTTLRVGELKSMLHLALGELEQALDWANWTLNMNSSVFTTEPVNYYRALISIIELHLDQNREPAQYRAVFEKMYGKDAVKQAWAAVSEGGNPFYNLPASDENLENFKEHQALLGAYGKLQKAKRAHQK

SEQ ID NO: 4251 - protein, 880 aa, H. influenzae strain 86-028NP
MTDSIQSSITPVNIEEELKSSYLDYAMSVIVGRALPDVRDGLKPVHRRVLFSMDREGNTANKKYVKSARVVGDVIGKYHPHGDSAVYDTIVRMAQPFSLRYMLVDGQGNFGSIDGDAPAAMRYTEVRMQKITQALLTDLDKETVNFSPNYDGELMIPDVLPTRIPALLANGSSGIAVGMATNIPPHNLNEVLNGCLAYIDNNEITIDELMQHIPGPDFPTAALINGRKGIEEAYRTGRGKVYVRARATVETNEKGREQIIVSELPYQVNKAKLVEKIAELIREKKIEGISNITDLSNKEGIRIEIDIKRDAVGEVVLNHLYSLTQMQVTFGINMVALDHGQPRLFNLKEIIESFVLHRREVVTRRSIFELRKARERTHILEGLAVARSNIDEMIAIIRNSKNREEAATAISSRSWTLHSDIINLLDVSARPDELEENLGIQGEQYYLSPAQVNAILELRLHRLTGIAFEEVIKEYEELLVKIADLLHILSSAERLMEVIREELEEVKAQFGDDRLTEITAASGDIDLEDLIAQEDVVVTLSHEGYVKYQPLTDYEAQRRGGKGKSATKMKEEDFIEKLLVANTHDTILCFSSRGRLYWLKVYQLPQASRGARGRPIVNILPLQENERITAILPVSAYEEDKFVVMATAGGIVKKIALTEFSRPRSNGIIALNLRDEDELIGVDITDGSNEIMLFSSQGRVVRFAENAVRAMGRLATGVRGIKLALTNDISDDESAVEIEDISDDNAEASLDLNIDKVVSLVVPKGEGEILTATQNGYGKRTQLSEYPTKSRNTKGVISIKVSERNGKVVAATQVEETDQIMLITDAGTLVRTRVSEVSIVGRNTQGVRLIRTADDEHVVSLERVCDADEEDSLEESSSEE

SEQ ID NO: 4252 - protein, 358 aa, H. influenzae strain 86-028NP
MSVQNVVLFDTQPLTLMLGGKLSHINVAYQTYGTLNAEKNNAVLICHALTGDAEPYFDDGRDGWWQNFMGAGLALDTDRYFFISSNVLGGCKGTTGPSSINPQTGKPYGSQFPNIVVQDIVKVQKALLEHLGISHLKAIIGGSFGGMQANQWAIDYPDFMDNIVNLCSSIYFSAEAIGFNHVMRQAVINDPNFNGGDYYEGTPPDQGLSIARMLGMLTYRTDLQLAKAFGRATKSDGSFWGDYFQVESYLSYQGKKFLERFDANSYLHLLRALDMYDPSLGYENVKEALSRIKARYTLVSVTTDQLFKPIDLYKSKQLLEQSGVDLHFYEFPSDYGHDAFLVDYDQFEKRIRDGLAGN

SEQ ID NO: 4253 - protein, 244 aa, H. influenzae strain 86-028NP
MRFTKSIKFSLKCGRFFIMFTAMLVKKLSPKFTVLFRALLYAIFALIILCLLVDRGVSFYVRDKIFTNIDELPFRPCALVLGTSKYTVSGKPNVYYDSRLMAAKSLIEQQKVNYLLLSGDNRTLQYNEPRAMFRDLRKMGVPETLMFRDFAGFRTLDSVIRADKIFQVKTFTIVSQKFHCERALLIAQAHNIDAICFVAKQPELHFSTQIREVFARIKAVFDLILGVEPYFLGEPQPLPNSTTL

SEQ ID NO: 4254 - protein, 437 aa, H. influenzae strain 86-028NP
MNNMQLKATSPLAEWLSYLEKSHFKPIDLGLDRIQSVAEKLDLLHPAPYVITVGGTNGKGTTCRLLETILLNHGLRVGVYSSPHLLRYNERVRIQNQDLPDEAHTASFAFIDENKTESLTYFEFSTLSALHLFKQAKLDVVILEVGLGGRLDATNIVDSHLAVITSIDIDHTDFLGDTREAIAFEKAGIFRENCPVVIGEPNVPQTMLDQAEKLHCQVARRDVDWLFEQNAENWQWQNKKVRLENLPFCQIPLANAATALAAVQYLPFDISEQTLRKSLQEVELVGRFQAIKTDKREKLADYLGVPVETLPTIIVDVGHNPHAAKYLSEKLTALKRSIEGKMIAVCGMLKDKDANGVFEHLTPIIDEWHCVTLGGYRGQSGDELAEKLKSHFPNIQATSDNSVMDGVCTALKSAVKNDVVLVFGSFHTVAEFWAVVE

SEQ ID NO: 4255 - protein, 296 aa, H. influenzae strain 86-028NP
MSWINRIFSKSPSSSTRKANVPEGVWTKCTACEQVLYSEELKRNLYVCPKCGHHMRIDARERLLNLLDEDSSQEIAADLEPKDILKFKDLKKYKDRINAAQKETGEKDALITMTGTLYNMPIVVAASNFAFMGGSMGSVVGAKFVKAAEKAMEMNCPFVCFSASGGARMQEALFSLMQMAKTSAVLAQMREKGVPFISVLTDPTLGGVSASFAMLGDLNIAEPKALIGFAGPRVIEQTVREKLPEGFQRSEFLLEKGAIDMIVKRSEMRQTLASVLSKLTNQPSPFVEPELISEDE

SEQ ID NO: 4256 - protein, 463 aa, H. influenzae strain 86-028NP
MKKTRFVLNSIALGLSVLSTSFVAQATLPSFVSEQNSLAPMLEKVQPAVVTLSVEGKAKVDSRSPFLDDIPEEFKFFFGDRFAEQFGGRGESKRNFRGLGSGVIINASKGYVLTNNHVIDGADKITVQLQDGREFKAKLVGKDEQSDIALVQLEKPSNLTEIKFADSDKLRVGDFTVAIGNPFGLGQTVTSGIVSALGRSTGSDSGTYENYIQTDAAVNRGNSGGALVNLNGELIGINTAIISPSGGNAGIAFAIPSNQASNLVQQILEFGQVRRGLLGIKGGELNADLAKAFNVSAQQGAFVSEVLPKSAAEKAGLKAGDIITAMNGQKISSFAEIRAKIATTGAGKEISLTYLRDGKSHDVKMKLQADDGSQLSSKTELPALDGATLKDYDAKGVKGIKITKIQPNSLAAQRGLKSGDIIIGINRQMIENIRELNKVLETEPSAVALNILRGDSNFYLLVQ

SEQ ID NO: 4257 - protein, 1146 aa, H. influenzae strain 86-028NP
MKTAFFQPDIPTQPNDHKILGNVLPGADALAISEIAEQNQNLTVVVTPDTRSAVRLSRVLSELSSQNVCLFPDWETLPYDTFSPHQEIISSRLSALFHLQNAKKGIFLLPISTLMQRLCPPQYLQHNVLLIKKGDRLVIDKMCLQLEAAGYRAVEQVLEHGEYAVRGSLLDLFPMGSAVPFRLDFFDDEIDSIRTFDVDTQRTLDEINSINLLPAHEFPTDDKGIEFFRAQFRETFGEIRRDPEHIYQQISKGTLISGIEYWQPLFFAEMATLFDYLPEQTLFVDMENNQTQGERFYQDAKQRYEQRKVDPMRPLLSPEKLWLNVDEVNRRLKSYPRITFKAEKVRSSVRQKNLPVAALPEVTIQSQQKEPLGQLRQFIEHFKGNVLFSVETEGRRETLLDLLSPLKLKPKQIQSLEQIENEKFSLLVSSLEQGFIIEQSLPVAIIGEANLLGERIQQRSRDKRKTINPDTLVRNLAELKIGQPVVHLDHGVGRYGGLVTLDTGGIKAEYLLLNYANESKLYVPVTSLHLISRYVGGSDESAPLHKLGNEAWAKSRQKAAEKIRDVAAELLDVYAQREAKKGFAFKYDREEFQQFSATFPFEETYDQEMAINAVISDMCQPKAMDRLVCGDVGFGKTEVAMRAAFLAVMNHKQVAVLVPTTLLAQQHYENFKDRFANLPVNVEVLSRFKTAKEQKQILENLAEGKVDILIGTHKLIQSDVKFNDLGLLIIDEEHRFGVGQKEKIKQLRANIDILTLTATPIPRTLNMAMNGIRDLSIISTPPARRLSIKTFVRQNGDLVVREAILREILRGGQVYYLHNDVASIENTAEKLTTLVPEARVIVGHGQMRERELERVMSDFYHQRYNVLVCSTIIETGIDVPTANTIIIERADHFGLAQLHQLRGRVGRSHHQAYAYLLTPPPKMMTKDAERRLDALENLDNLGAGFILATHDLEIRGAGELLGNEQSGQIESIGFSLYMELLDAAVKALKEGREPSLEELTQQQADIELRVPALLPDDYLGDVNMRLSFYKRIAAAESKAELDELKVELIDRFGLLPDATKNLLQITELRLLVEPLNVVRIDAGTQGGFIEFSAKAQVNPDKFIQLIQKEPIVYRFDGPLKFKFMKDLSDNKVRLEFVVDLLRTIAA

SEQ ID NO: 4258 - protein, 57 aa, H. influenzae strain 86-028NP
MTEQTAKPKGWFKRALEKYDNFIKEWGLDQPNCSCVPMSATEDENGNLKTKESSLKK

SEQ ID NO: 4259 - protein, 656 aa, H. influenzae strain 86-028NP
MSSRQLQILICKTLPLVPDNVLIIGESGIAFSKATNLLGQEFEHILFDARNGIHLEALAIAAGTLKMGGTLCLVLSDWENLSQQPDQDSLRWNGNQSAIATPNFIDHFKQCIERYHFPILREESAVEFPTVFYSNEHHKNATLAQQQIIETILQAEQDIYFLTSKRGRGKSALLGMLANQIQAPVYLTAPNKSAVHSVIEFSEREIEFIAPDELAIRLQHEPEFSQSAWLLVDEAAVIPLPLLQEYSQYFQHIVFSTTIHSYEGTGRGFELKFKRKIHRTFQHFELKQPLRWQENDPLEHFIDDLLLLNAEDDFQHFDYNNITYNIEENAKNLSFPCLRGKVPEGRKGDLDIASLPQALEAPLTSKGSKGKYNRQFLFRDFYGLTTLAHYRTSPLDLRRLLDGENQRFYFAEYQQNLLGAIWALEEGNMADDELIIQIQQGKRRPKGNLVPQALCFYENLPQACKLRSLRISRIAVQPNWQQKGIGQNLMQAMENADVDFLSVSFGYTDELAKFWQKCGFVLVHLGEHQEASSGCYSAIALKGLSKEGLALVDTAYKQFQRNLPLSFHPFAINFEQNQLDWQLDDFDWMSLKNFANFHRTLFSSVPAMRRLLKLAGKENFPLISAYLTKKQLPINKKKGVECLRLEIKQYLERGTL

SEQ ID NO: 4260 - protein, 113 aa, H. influenzae strain 86-028NP
MLVDLHIFFAFLSLALLVIRGAMQLNGKNWRSIKLLKILPHLSDTLLIVSGVVILYLFAFGIEWWLVAKFALLILYIVFAAKFFSKKVSQPKSIFFWLACVSFIGAMLIAYLK

SEQ ID NO: 4261 - protein, 556 aa, H. influenzae strain 86-028NP
MSSQFVYTMHRVGKVVPPKRHILKDISLSFFPGAKIGVLGLNGAGKSTLLRIMAGVDKEFEGEARPQPGIKIGYLPQEPKLEPQQTVREAVEEAVSEVKNALTRLDEVYALYADPDADFDKLAAEQANLEAIIQAHDGHNLDNQLERAADALRLPDWDAKIEHLSGGERRRVALCRLLLEKPDMLLLDEPTNHLDAESVAWLERFLHDYEGTVVAITHDRYFLDNVAGWILELDRGEGIPWEGNYSSWLEQKEKRLEQEQATENARQKSIAKELEWVRQNPKGRQAKSKARMARFDELNSGEYQKRNETNELFIPPGPRLGDKVIEVQNLTKSYGDRTLIDDLSFSIPKGAIVGIIGANGAGKSTLFRMLSGQEQPDSGSVTMGETVVLASVDQFRDSMDDKKTVWEEVSNGQDILTIGNFEIPSRAYVGRFNFKGVDQQKRVGELSGGERGRLHLAKLLQRGGNVLLLDEPTNDLDVETLRALENAILEFPGCAMVISHDRWFLDRIATHILDYGDEGKVTFYEGNFSDYEEWKKKTLGDAATQPHRIKYKRIAK

SEQ ID NO: 4262 - protein, 107 aa, H. influenzae strain 86-028NP
MMTRKPTSVGEILQEEFLEPLSLKISDLAQILDVHRNTASNIVNNSSRITLEMAVKLAKVFDTTPEFWLNLQTRIDLWDLEHNKRFQQSLANVKPALHRHDTSTFAM

SEQ ID NO: 4263 - protein, 101 aa, H. influenzae strain 86-028NP
MFNLKREHFRDDYLYRFYQYGDTHSKIPSNLYKVLARKLDMISASENINDLRSPPANHLELLEPKENKIYSIRVNKQYRLIFKYENNEVNNLYLDPHSYNL

SEQ ID NO: 4264 - protein, 206 aa, H. influenzae strain 86-028NP
VKTYSLLLGLFISFGVLAHPHAFIDIQTTPIIENNQLTGFSMKWTLDEPSSSAVIYDMKQARTKAEKQKLLDDVMGNIVSEHYFSYLYDAQNNKIKYSPRPKNYGINVQGLQLQYYFDVPLAHPQKLEKNTFSLQTYDPTYYVAMTYASKSAVDFSALSKNCQGKLIEPNVDEKIQAYASSLDKSQKNEDDSLGVMFAQKIIIQCE

SEQ ID NO: 4265 - protein, 322 aa, H. influenzae strain 86-028NP
MKKYKTGLVLLVIALALLVYFSPWFFLHIASWQKEFNQLISENLHQIQNNSIKAGITLIFVSFIYGVLHALGPGHGKFIIASYLSTHESQLKQSTILSLLSSLMQGIVAITATTLLVVVLNLSSRYFKLSQLWLERTALLLLVFLGCYWIWQGLRAYRKKAKLTIKSLNPLPLHEKSAVKNNRTFQPNTCSCGHQHLPSPTQTAQATNLKSQFLVILTIGMRPCSGAIFVLFLAYMLDLYSWGILAVLAMSFGTGLMLSAFAGIVRYARNTAIHLGHWYSSKNTKGKSESIVKLIAGGIMLFFALSLLYGTTISTGGSKILF

SEQ ID NO: 4266 - protein, 679 aa, H. influenzae strain 86-028NP
MSEKINTKPFILHSDFRPSGDQPQAIEKLAENLTDGLAHQTLLGVTGSGKTFTIANVIAQLNRPAMLLAPNKTLAAQLYAEMKAFFPENAVEYFVSYYDYYQPEAYVPSSDTFIEKDASINDQIEQMRLSATKSFLERRDTIVVASVSAIYGLGDPDSYLQMMLHLQQGAIIDQRQILAKLAELQYTRNDQAFQRGTFRVRGEIIDIFPAESDDRAVRIELFDDEIERLSLFDPLTGSSFGAVPRFTIYPKTHYVTPRERILDAIENIKKELVSRREYFIKEHKLLEEQRISQRTQFDIEMMNELGYCSGIENYSRYLSGRNEGEPPPTLFDYMPSDAILIIDESHVTVPQIGGMYRGDRSRKETLVEYGFRLPSALDNRPLRFEEFERLAPQTIYVSATPGPYELEKSGTEIIDQVVRPTGLLDPLIEIRPVSIQVDDLLSEARQRADKNERVLVTTLTKKMAEDLTDYLDEHGIRVRYLHSDIDTVERVEIIRDLRLGEFDVLVGINLLREGLDIPEVSLVAILDADKEGFLRSERSLIQTIGRAARNLNGKAILYADSITKSMEKAITETNRRREKQIKYNEEHGIVPQALNKKVGELLDIGQGANQKAKANKQRGKMAAEPTALYNAPKNAKEYQQQIKKLEQQMYKFAQDLEFEKAAAIRDQLHQLREQFVFDN

SEQ ID NO: 4267 - protein, 641 aa, H. influenzae strain 86-028NP
MKKAHFPLFPIFTFVLINLIILSLSRLGLAVWQSERVSAVDGWLQLFLQGVRMDVVALCYLFGVPALLTTLFHSSKVWVKILRLWLTLGSVFIIFMEIATPAFIETYDYRPNRLFIEYLIYPKEVFSMLAEGHLSAVIFSLVFTILAAVIYWKISGWAVKNLGSISWKLRPVIALLVIVLSFLGARSSFQHRGINPAMVAFSSDALVNSLVLNSGYSVIYAAQQFKDEEKSSEMYGKMDADEIFRIVKASRGRPESDYISDKYPTLTKNVATYQGKPKNIVILLQESLGAQFIGTLGGKPLSPNVDQLAKEGWLFENLYATGTRSVRGIEATTAGFTPTPARAVVKLNNAQSGFFTIADLLHKQGYNTSFIYGGEKHFDNMASFFYGNGFKDIWDQQDYQNPKFTGTWGVSDEDLFDKANETFTKLQNEGKPFFSLVFSSSNHDPFEYPDGKIELYEQPKATRNNAAKYADYALGHFFKMAKQSNYWKDTIFLIVADHDSRVGGASLVPIKHFHIPALILGDGITPRRDSRLVSQIDMPTTLLSLAGVSGNYPMIGFDLTQDVNPDRAFMQYDQTQAMMKGNNDVVIQMSNKAAQGYHYDKSTETLTPKDVPDAMKKEALAHALLGSYLYKNRLYSSGENK

SEQ ID NO: 4268 - protein, 756 aa, H. influenzae strain 86-028NP
MSEQLRQAALDFHEFPIPGKIEVTPTKSLATQRDLALAYSPGVAEPCLEIEKDPAASYKYTARGNLVAVISNGTAVLGLGNIGALAGKPVMEGKGVLFKKFAGINVFDIEVNEHDPDKLVDIIASLEPTFGGVNLEDIKAPECFYIEQKLRERMNIPVFHDDQHGTAIISAAAIINSLRIVGKKIEDVRLVASGAGAASIACLNLLLSLGMKRENITVCDSKGVVYKGRDDKMDQTKKDYAIEDNGWRKLGDAMPNADIFLGCSAAGALTQDMVKTMAAHPIILALANPNPEITPPEAKAVRPDAIVCTGRSDYPNQVNNVLCFPFIFRGALDVGATTINEEMKRAAVYAIADLALEEQNEVVTSAYGGEGATFGADYVIPRPFDPRLIVRIAPAVAKAAMESGVATRPIQNWDIYIDQLTQFVYKTNLFMRPIFSQAKSAKQRIILAEGEENKALHATQEVISMGLANPILIGRRSVIEEKIKKLGLRLTAGVDFEIVDNEDNPRYEECWKHYYELTKRKGITPAIAKRVVRSNTTVLASTLLSLGYADALVCGLFGSYGKHLASIRDIIGLKDGVKTAAALNSLVLPTGNVFLTDTHVNSNPTAEELAEITLMAAEEIHRFGIEPAVALLSHSNFGSSDSLGAPKMREVLQIVKERNPHLMIDGEMRGDLAMNEAHRKEVMPDSPLKGSANLLVFPDLSASRISYSLLRSTTTAITVGPILMGMNKSAHILNPGASVRRIINMIAYAAVKAQQE

SEQ ID NO: 4269 - protein, 206 aa, H. influenzae strain 86-028NP
MNPFQKIKSAVNKCQRFFINRSLQRKLTNQGMTVISANCVGAFILHDLHQPFNSPFVNLCLSPQDFLRYLQNMDFYRTQPLTFVQTEKSYPVGKLADLEIHFMHYHSEQEANEKWQLRTSRMKLDNLFIMMTDRDGVTEKDIQLFDQLPFKNKVIFTHKPYPAFKSAYYIKGFEKQNQVGDIFEFSGWNGKKYYDQFDYLKWFNQA

SEQ ID NO: 4270 - protein, 232 aa, H. influenzae strain 86-028NP
MRLDKFIAENVGLTRSQATKAIRQSAVKINGEIVKSGAVQISQEDKIYFEDELLTWVEEGQYFMLHKPQGCVCSNDDGDYPTIYQFFDYPLAGKLHSAGRLDVDTTGFVLLTDDGQWSHRITSPKHHCEKTYLVTLADPVEENYAAACSEGILLRREKEPTKPAKLEILDDYNVNLTISEGRYHQVKRMFAALGNKVVGLHRWKIGDVVLDESLEEGEYRPLTQSEIEKLVK

SEQ ID NO: 4271 - protein, 398 aa, H. influenzae strain 86-028NP
MNQQKSTFIFILTLGILSMLPPFGVDMYLPSFLEIAKDLGVSPEQVQHTLTSFAYGMAFGQLFWGPFGDSFGRKPIILLGVIVGALTALVLTEINSVGNFTALRFVQGFFGAAPVVLSGALLRDLFSKDQLSKVMSTITLVFMLAPLVAPIIGGYIVKFFHWHAIFYVISLVGLLAAALVFFIIPETHKKENRIPLRLNIIARNFLLLWKQKEVLGYMFAASFSFGGLFAFVTAGSIVYIGIYGVPVDQFGYFFMMNIVTMIFASFLNSRFVTKVGAETMLRIALAIQFLSGMWLILTALLDLGFWPMAIGVAFFVGPNPVISSNAMASALEKCPQMAGTTNSLIGSVRFAVGAIMGSLVASMKMDTAAPMLFTMGACVVISVLAYYFLTSRNLKSRG

SEQ ID NO: 4272 - protein, 266 aa, H. influenzae strain 86-028NP
MSEQSSKYIAALLAVLSISMVLGIDLFIFSLQSEKQTMPHLGVGVLVAQLISLLVFYRGEICPGQRGRLIKVNMTFAIYWAVWLLISLLQNNHTLTNVMSVCGLSVVYFIWKQPKTEKIRNSFLLMAALIAGLGCLSYLMIFTVLPASDFAEYNPFAPILSGVILANLALVIARNRLQGFIALLPLAMIILLALNALAMFLFLLLNGMESAVNSDSVFAYIIYFVCHFVIAAILILHSFQKWILSTNSLFILLFIAVCLPLWMVFV

SEQ ID NO: 4273 - protein, 220 aa, H. influenzae strain 86-028NP
MLLSILYIIGITAEGMTGALAAGREKMDIFGVIIIASVTAIGGGSVRDVLLGHYPLGWVKHPEYFLMVASAAVITVYVAPFINHFMRYFRTIFLVLDAMGLVVYSIIGAQIAMDMGHSLTIVCIAGCITGAFGGVLRDMLCNRIPLVFQKELYASIALFATLTYYALSTLQVEHTLAVLLTLISSFTLRLLAIHFEWGLPVFNYQELTSEEQDKLPNKKK

SEQ ID NO: 4274 - protein, 417 aa, H. influenzae strain 86-028NP
MLEQMGKQAKDAAFILAQLTTAEKNCALSIIAEQLQQQAPLILAENAKDIELAKQNGLSDALIDRLLLTQERLQSIANDVRHVISLADPVGKIIDGGTLDSGLKIERVRTPLGVIGTIYEARPNVTIDVASLCLKTGNAVILRGGKETQFSNKILIEVVQNALEQAGLPKFAVQAITDPNRELVMQLLKLDRYVDMIIPRGGSGLHELCKQHSTIPVIVGGVGVCHTFVEKSADQNKAIFVIDNAKTQRPSTCNTLETLLVQHSIAEEFLPKLVSHLATKNVKYHAKSTALNILKQAGANVCEVTEKELRKEWGSLDLNVVVVEDIHAAIEHIRQYGTQHSESILTSSQNLARQFINQVDAAAVYVNASTRFTDGGQFGLGAEVAVSTQKLHARGPMGLEALTSYKWVCEGEYTVRK

SEQ ID NO: 4275 - protein, 381 aa, H. influenzae strain 86-028NP
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 4276 - protein, 635 aa, H. influenzae strain 86-028NP
MGKIIGIDLGTTNSCVAVMDGDKARVIENAEGARTTPSIIAYTDNETLVGQPAKRQAITNPKNTLFAIKRLIGRRFESEEVQRDIKIMPFEITRADNGDAWVNVKGDKLAPPQISAEVLKKMKKTAEDFLGESVTEAVITVPAYFNDAQRQATIDAGKIAGLDVKRIINEPTAAALAFGLGSSKENQVIAVYDLGGGTFDISIIEIDNFDGEQTFEVLATGGNTHLGGEDFDNRVIDYIIDEFKKEQNIDLRNDAMALQRVKEAAEKAKIELSSAQSTEVNLPYITADATGPKHLALNITRAKLEALVEDLVASSIESLKAVLKDADKGVSEIHDIILVGGQTRMPLVQQKVAEFFGKEARKDVNPDEAVAIGAAVQGGVLKGDVKDVLLLDVTPLSLGIETMGGVMTTLIEKNTTIPTKKSQVFSTAEDNQSAVTIHVLQGERKRAADNKSLGQFNLEGINPAPRGMPQIEVTFDIDANGVINVSAKDKNTGKEQQIRIQASSGLSDEEIQQMVRDAEANADADRKFEEVVQARNQADGIAHATRKQIAEAGDALSVADKEKIEAAVAELETAAKGEDKAEIEAKIEAVIKASEPLMQAVQAKAQQAGGEQPQQSSAKDDGVVDAEFEEVKDNK

SEQ ID NO: 4277 - protein, 480 aa, H. influenzae strain 86-028NP
MKKSKIAAGVVISLAAVWCAGAWFTGKKAEEEYLHQLKQLNQLFTKTEALEESKIFYKNIKFERGLFASHIQDQIEIHKANETIIIPLSSTLYHGPLPLDRVAKLNFVPAIFSSQTLLGKNATTQAFFDITESEKPLQLNFAMNYSLSGNAELKLASGQYHNEQSKTDFDWSNVVLNIDLNQNTPNNYVLSVDTFNSNAPNHAVSTASSIKIKDLVVQGSLQSTKWPFIYSGNINSKIGYFEQNTESPETGEKFSLIQKNSQANLTTQVEGDTVNIINKTNLDELHINGNNLGKVTNNVEFNHIDGNALQELLNILVAIGKADSDMPLSKTLVQKLQQAGMIIANNQPQIKFTPLSISDEKGKVALDLNIALVPNPKFDLMRSGLYKQFKDFSINFDVNKETAISLLSKFVPENQKQDFVHRLNELVTEGEVNDIIVNTDKTVTLTLALENNDLKLNGKPIPEEQLKVVLFILVMGGFGR

SEQ ID NO: 4278 - protein, 152 aa, H. influenzae strain 86-028NP
MQTTTRTLTQHKRIALVAHDSCKKNLLNWTQKHKEALKPHILYATGTTGHILERETGLSIQSLLSGPMGGDQQLGGLIAEKKIDMMIFFWDPMNAAPHDPDVKALMRIATVWNIPVAINQSSADFLLTSVLFEQDVEIDVPDYEGYLKERLA

SEQ ID NO: 4279 - protein, 886 aa, H. influenzae strain 86-028NP
MSEILKNDIDPIETQDWLQSLDSLIREEGVERAQYIVEQVIGQARTSGVSLPTGVTTDYVNTIPVAEQPAYPGDHAIERRIRSAVRWNAIAMVLRSQKKDLDLGGHISTFQSAATMYEVCYNHFFKAATEKNGGDLIFFQGHAAPGMYARAFLEGRLTEEQMDNFRQEAFTDGLSSYPHPKLMPEFWQFSTVSMGLGPVNAIYQARFLKYLDNRGLKDTKDQKVYAFLGDGEMDEIESKGALTFAAREKLDNLIFTISCNLQRLDGPVNGNGKIVQELEGLFTGAGWEVIKVLWGSDWDKLFAKDTSGKLTQLMMEVVDGDYLTFKSKDGAYIREHFFGRYPETAALVADMTDDEIWALRRGAHDSEKLYAAYAKAQNATKPVVILAHQVKGYKIPEAESKNTAHQSKKMSYESLKGFRDFFELPLTDEQVEKLEYIKFAEGTPEYEYLHGHRKALNGYVPARRTKFDVEYKVPALEEFKALLEEQPRGISTTMAFTRALNILLKDKNIGKTIVPMIADEARTFGMEGLFRQVGIYNPHGQNYVPSDRDLVAYYREAKDGQVLQEGINELGATASWLAAANSYSVNNQPMIPFFIYYSMFGFQRVGDMMWAAGDQLARGFMVGGTSGRTTLNGEGLQHEDGHSHIQAGVIPNCVTYDPSFAFEVAVIMQDGINRMYGEKQEDVFYYMTTLNEVMDQPAMPAGAEEGIRKGLYKFETVEGKKGKGHVQLLGSGAIMRHVREAAQILANDYGVTSDVFSAPSFNELAREGHDAARWNLLHPTETQRVPYVAQVLADLPTVASTDYVKGYADQIRAFVPSKHYHVLGTDGFGRSDSRANLREHFEVDARYVVVAALSQLAKEGTVSNQVVADAIAKFGLNVDRINPLYA

SEQ ID NO: 4280 - protein, 565 aa, H. influenzae strain 86-028NP
MSKQIQIPDIGSDEVTVTEVMVNVGDTISVDQSIINVEGDKASMEVPAPEAGVVKEILVKVGDKVSTGTPMLVLEAAGAAPAADEPTAPVADAPTAPVVATAPTASAIVEVNVPDIGGDEVNVTEIMVAVGDTITEEQSLISVEGDKASMEVPAPFGGVVKEILVKSGDKVSTGSLIMRFEVLGAAPAASASASTSAPQTAAPATTAQAPQAAAPATTAQAPQAAAPDTTAQAAQSNNNVSGLSQEQVEASTGYAHATPVIRRLAREFGVNLDKVKGTGRKGRIVKEDIEAYVKTAVKAYESGATAQATGNGVANGAGLGLLPWPKVDFSKFGEIEEVELSRINKISGANLHRNWVIIPHVTHFDKADITDLEAFRKEQNALAEKQKLGVKITPVVFIMKAVAKALEAYPRFNSSITEDAQRLILKKYINIGVAVDTPNGLVVPVFKNVNKKGIIELSRELMEVSKKAREGKLTASDMQGGCFTISSLGGIGTTHFAPIVNAPEVAILGVSKSSMEPVWNGKEFAPRLILPMSLSFDHRVIDGADGARFISYLGSVLADLRRLVM

SEQ ID NO: 4281 - protein, 474 aa, H. influenzae strain 86-028NP
MSKEIKTQVVVLGAGPAGYSAAFRCADLGLETVIVERYSTLGGVCLNVGCIPSKALLHVAKVIEEAKHANKNGIYFSEPRIELDEVRAGKEAVVAKLTGGLAGMAKARKVTVVEGLATFTDSHTLVARDRDGNPTTVKFDNAIIAAGSRPVQLPFIPHEDPRIWDSTDALKLKEVPKKLLIMGGGIIGLEMGTVYNALGSEVEVVEMFDQVIPAADKDVVGIYTKQVEKKFKLMLETKVTAVEAKDDGIYVSMEGKACNDTKRYDAVLVAIGRVPNGKLIDAGKAGVEVDDRGFIHVDKQMRTNVPHIYAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRILGGAIVGSNGGELLGEIGLAIEMGCDAEDIALTIHAHPTLHESVGLAAEVFEGSITDLPNAKAKKK

SEQ ID NO: 4282 - protein, 35 aa, H. influenzae strain 86-028NP
MLKSAVKKRNVFRLAFYHKKIEREENKNPQLGIFI

SEQ ID NO: 4283 - protein, 180 aa, H. influenzae strain 86-028NP
MTTQLDLIKSSIKSIPNYPKEGIIFRDITTLLEVPAAFKATIDLIVEQYRDKGITKVLGTESRGFIFGAPVALALGLPFELVRKPKKLPRETISQSYQLEYGQDTLEMHVDAISEGDNVLIIDDLLATGGTVEATVKLVQRLGGAVKHAAFVINLPELGGEKRLNNLGVDCYTLVNFEGH

SEQ ID NO: 4284 - protein, 688 aa, H. influenzae strain 86-028NP
MSYQVLARKWRPKTFADVVGQEHIITALANGLKDNRLHHAYLFSGTRGVGKTSIARLFAKGLNCVHGVTATPCGECENCKTIEQGNFIDLIEIDAASRTKVEDTRELLDNVQYKPVVGRFKVYLIDEVHMLSRHSFNALLKTLEEPPEYVKFLLATTDPQKLPVTILSRCLQFHLKALDETQISQHLAHILTQENIPFEEPALVKLAKAAQGSIRDSLSLTDQAIAMGDRQVTNNVVSNMLGLLDDNYSVDILYALHQGNGELLMRTLQRVADAAGDWDKLLGECAEKLHQIALMQLLPQKSSDDNEHFSFLAKHISPEDVQFFYQVIVSGRKDLSNAPNRRIGAEMTLLRALAFHPKFLTAVPKTNTTITPPPSTPSAVENTGNYVDVPVLSQSIKSAYSQAKPNKTSIPNLASLSALDALEHLTQLENQERQEHKAESLAVVSETLHHIQELDEEKSHKKMTALPVREMTEPKPKHIEKPTSPPNAAQAPQENSTEENSSDDNAEVAQDEQEILSADTYRWEWSNPELAKADTGVRPSDIKQAILKDITPELRLKIITQTQQQDEWADIVERSGVTGFSKELALNCFLQSKTDDEINLGLHSEKSHLRQDRSIKNLVEALSKLQGKDIRLTINLDDSNVATPIEYRRNIYQALREKAQNELQKDSKLQMLLNEFDAKLDVESIRPV

SEQ ID NO: 4285 - protein, 208 aa, H. influenzae strain 86-028NP
MKLVEVKHPLVKHKLGVMREAEIDTKKFRELATEIGSLLTYEATSDLETEKVTINSWNGPVEIDRIKGKKVTVVPILRAGLGMMDGVLEHVPSARISVVGIYRNEETLKPVPYFQKLASDLEERLAIVVDPMLATGGSMIATLDLLKAKGCKHIKVLVLVAAPEGIKALEAAHPDIELYCASIDSHLNEQGYIIPGLGDAGDKIFGTK

SEQ ID NO: 4286 - protein, 414 aa, H. influenzae strain 86-028NP
MTNQTSSFPSENQSKLKQSFVGLQMLFVAFGALVLVPLITGLDSNTALLTAGVGTLLFQFCTGKQVPIFLASSFAFIAPIQYGVQTWGIATTMGGLAFTGLVYFALSTLVKLRGAEALQRFFPPVVVGPVIIIIGMGLAPIAVDMSLGKNSNYAYNDAVLVSMVTLLTTLSVAVFAKGLMKLIPIMFGITVGYILCLFLGLINFQPVIDAPWFSLPKLTTPEFNLEAILYMLPIAIAPAVEHVGGIMAISSVTGKDFLKKPGLHRTLLGDGVATAAASLVGGPPNTTYAEVTGAVMLTRNFNPNIMTWAAVWAIAISFCGKVGAFLSTIPTIVMGGIMMLVFGSIAVVGISTLIRGKVDVTEARNLCIISVVMTFGIGNMFVDVGNVSLKGISLCAIVAIILNLVLPKAKNEVE

SEQ ID NO: 4287 - protein, 231 aa, H. influenzae strain 86-028NP
LNKQLPLPIHQINDATLENFYGDNNLLLLDSLRKNSSDLKQPFFYIWGDKGSGKTHLLRAFSNEYLINQRTAIYVPLSKSQYFSTAVLENLEQQELVCLDDLQSVIGNDEWELAIFDLFNRIKASGKTLLLISADKSPSALSVKLPDLNSRLTWGEIYQLNSLTDEQKVEVLQHTAYQRGFQLSDETANFLITRLARDMHTLFEALDLLDKASLQAQRNLTIPFVKEILNL

SEQ ID NO: 4288 - protein, 93 aa, H. influenzae strain 86-028NP
MSDFVLVYSTDVGRIKEEKASVVRPKGDGVVRIQKQTSGRKGAGVSVITGLDLSDEDLKKLAAELKKRCGCGGSVKNGIIEFKGKNEICSSNY

SEQ ID NO: 4289 - protein, 230 aa, H. influenzae strain 86-028NP
MTSKIIVALDYEKEAEALALVDQIDPSLCRLKVGKEMFTTLGINFVKQLHQRNFDVFLDLKYHDIPNTVARAVRSAADLGVWMVDLHASGGLRMMEEAKKILEPYGKDAPLLIAVTVLTSMEDLDLLQIGINASPMEQVLRLAHLTQRAGLDGVVCSPQEVEILRNTCGKEFKLVTPGIRPIGTDFGDQRRVMTPTAAIRAGSDYLVIGRPITQADNPAEVLRSINVSIG

SEQ ID NO: 4290 - protein, 396 aa, H. influenzae strain 86-028NP
MIELLFLLLPIAAAYGWYMGRRSAKKDQDDISNKLSRDYVTGVNFLLSNQTDKAVDLFLDMLQKQEIENEIESHSQFEAELTLGNLFRSRGEVDRALRIHQALDLSPNYTFEQKLLAKQQLARDFMVVGFFDRAENLYILLVDEPEFAENALQQLLVIYQKTKEWKKAVNIAEKLAKIKPQENNIELAQCYCEYSQSLEPESAVEKRSVLQKALSVSPTCVRASLLLANLAMLDGQYQQAVEILENVLEQNPDYTGEILSPLKHCYEELNQLDNFELFLIRAGQIINNDEVELALVKLIEEKDGKSAAQAKLYQQLTKNPSTLIFHRFMQYQIDDAEDGRGKESLILLHKMVGERIKQTSPYRCTNCGYQIHKLLWNCPSCRQWESIKPVSNQEHN

SEQ ID NO: 4291 - protein, 97 aa, H. influenzae strain 86-028NP
MIKYILGIVIFIAIVLVAITIGANNDQIITFNYIVAESQFQLSSLVAILFGLGLILGWLITAFFYIKLKLKNMALARQVKRQTLQINELTTTRDKVA

SEQ ID NO: 4292 - protein, 94 aa, H. influenzae strain 86-028NP; identical to SEQ ID NO: 646

SEQ ID NO: 4293 - protein, 549 aa, H. influenzae strain 86-028NP
MSESFAQLFEESLKGLETRQGSIVSGTVVAIQKGFVLVDAGLKSESAIPVAEFLNAQGELEIQVGDTVNVALDAVEDGFGETKLSREKAVRHESWIELEKAYEEKATVIGLINGKVKGGFTVELNGVRAFLPGSLVDTRPAREADHLLGKELEFKVIKLDQKRNNVVVSRRAVIESENSQEREQVLENLVEGSEVKGIVKNLTEYGAFVDLGGVDGLLHITDMAWKRVKHPSEIVNVGDEVTVKVLKFDKDRTRVSLGLKQLGQDPWAAIAENHPVNSKLTGKVTNLTDYGCFVEILDGVEGLVHVSEMDWTNKNIHPSKVVSLGDTVEVMVLEIDEERRRISLGLKQCKANPWTQFADTHNKGDKVTGKIKSITDFGIFIGLEGGIDGLVHLSDISWSISGEEAVRQYKKGDEVSAVVLAVDAVKERISLGIKQLEEDPFNNFVAINKKGAVVSATVVEADAKGAKVELAGGVEGYIRSADLTSEVAIGDVVEAKYTGVDRKSRIVHLSVKAKDQAEEAAAVASVNNKQEDIVIPNAMAEAFKAAKGE

SEQ ID NO: 4294 - protein, 264 aa, H. influenzae strain 86-028NP
VKLTLLDKPYKTWKLVIISRMVMRGNCLYNAQNFDNERIICMGMIITVDGPSGAGKGTLCYALAEKLGYALLDSGAIYRVTALAALQRKTDLTNETDLAELARHLDIQFIPQNGEVNILLAGMDVSRLIRTQEVADAASKVAVFQKVRSALLQLQQDFAKNDGLIADGRDMGTVVFPNAQVKLFLDASAEERAKRRYKQLQNKGINGNFAQILAEIKERDLRDRNREVAPLKPADDALLLDSTALSINEVIDQALSYIQEKVSV

SEQ ID NO: 4295 - protein, 291 aa, H. influenzae strain 86-028NP; identical to SEQ ID NO: 636

SEQ ID NO: 4296 - protein, 192 aa, H. influenzae strain 86-028NP
MKIGILALQGAFAEHARMLEKLGIESVELRNLKNFQQHYSDLSGLILPGGESTAIGKLLRELYMLEPIKQAISSGFPVFGTCAGLILLAKEITSQKESHFGTMDIVVERNAYGRQLGSFYTEADCKGVGKIPMTFIRGPIISSVGKKVNILATVNNKIVAAQEKNMLVTSFHPELTNNLSLHKYFIDICKVA

SEQ ID NO: 4297 - protein, 564 aa, H. influenzae strain 86-028NP
MSVQQLISRLTDIVGSRYIITDPTKTEAYRSGYRFGTGNALAVVRPATLLEFWNIVKVCVEHDVIVINQAANTGLTGGSTPDGNDYDRDIVVINTMRIDGIKLINNASQVICLPGSTLNELENQLKPFGREPHSVIGSSCIGASVIGGICNNSGGALVQRGPAYTEMALYAQLNEKGELELKNHLGIDLGETPEEILTNLQEKRYQVKDIRQDCGHGHDHYYCNYVRQVDEGSPARFNADPARHYEASGCAGKLAVFAVRLDTFPLEKETAVFYIGTNQTSVLSDIRRHMLVNFEVLPISGEYIHRDAFDIAAKYGKDTFWVIKKFGTHWLPKLFSLKSNVDRIGKKFFFLPQHLSDKLMQTVSKFIPEHLPQSLWDYRNKYEHHLIIKMGGKGIQEAREYLESYIADGSKGGYFECNAIETQAAMLHRFAVASAAIRYRAIHEKEVEEIVALDVALRRNDQDWFEVLPPEIDNRIISKLYYGHFMCHVFHQDYIVKKGYDYEELEYEMLKLLDKRGAQYPAEHNVGHLYEAKPTLRKFYKELDPTNSFNPGIGKTTRKKYWAE

SEQ ID NO: 4298 - protein, 36 aa, H. influenzae strain 86-028NP
MPNERNIQNYHSTYNNIRDWLGYQKAGEEKAKSTIN

SEQ ID NO: 4299 - protein, 183 aa, H. influenzae strain 86-028NP
MLKRILVIIGLAVLATACSNAPRTVSHQVISENDDIQLTGLINNLEKDNRTGIFHKVRTNRSSALMGDKALASVYNEWVGTRYRMGGTTKRGIDCSAFMQTTFSEVFGIELPRSTAEQRHLGRKINKSELKKGDLVFFRKNNHVGVYIGNNQFMHASTGQGVTISSLDEKYWARTYTQSRRIM

SEQ ID NO: 4300 - protein, 482 aa, H. influenzae strain 86-028NP
MLNQVSNTLLTPSNLSTQTLLNIFDIMSHRNIDYADLYFQLSQDESWVLEDGIIKEGGFHIDRGVGVRAVSGEKTGFAYADQINLASLQQCAEAVKGIAQVKQGNLISLSAFNVVNPIARYAAINPLESLTKEKKIELLHLVDRTARAEDHRVTKVSASLSSVYEEVLIMATDGTLAADIRPLVRLSISVLVEENGKRERGSCGSGGRFGLDWFFEVVDGDIRAVLFAKEAVRQALVNLSAVAAPAGLMPVVLGAGWPGVLLHEAVGHGLEGDFNRKESSLFTGKIGEQVTSPLCTIVDDGTIENRRGSLTIDDEGVPSQCNVLIKDGILQGYMQDKMNARLMGVAPTGNGRRESYAHLPMPRMTNTYMLAGQSQFDDLIASVKQGIYAPHFGGGQVDITSGKFVFSTSEAYLIEKGKITKPVKGATLIGSGIEVMQKISMVADKSELDLGIGVCGKEGQSVPVGVGQPALKIDEITVGGTN

SEQ ID NO: 4301 - protein, 283 aa, H. influenzae strain 86-028NP
MTDLTGILYIVATPIGNLQDITQRALETFAQVDLIAAEDTRHSGLLLIHYGIKKPFFALHDHNEQEKAHILVEKLKQGSNIALISDAGTPLISDPGFHLVRQCREAGIRVVPLPGACAAITALCASGIASDRFCFEGFLPAKSKARKDKLENIAEEDRTLIFYESTHRILDTLEDMQAVLGEGRYIVLAREMTKTWETITGNTIKNLREWLLEDPNRTKGEMVLIVEGKPKSDNNDEISPQAVKALELIAEELPLKKAAAIVAELYGYKKNALYQFGLAHLEK

SEQ ID NO: 4302 - protein, 575 aa, H. influenzae strain 86-028NP
MSILLQGERFKKRLMPILLSMALAGCSNLLGSNFTQTLQKDANASSEFYINKLGQTQELEDQQTYKLLAARVLIRENKVEQSAALLRELGELNDAQKLDRALIEARISAAKNANEVAQNQLRALDLNKLSPSQKSRYYETLAIVAENRKDMIEAVKARIEMDKNLTDVQRRQDNIDKTWALLRSANTGVINNASDEGNAALGGWLTLIKAYNDYIRQPVQLSQALQSWKNAYPNHAAATLYPKELLTLLNFQQTNVSQIGLLLPLSGDGQILGTTIQSGFNDAKGNSTIPVQVFDTSMNSVQDIIAQAKQAGIKTLVGPLLKQNLDVILADPAQIQGMDVLALNATPHSRAIPQLCYYGLSPEDEAESAANKMWNDGVRNPLVAMPQNDLGQRVGNAFNVRWQQLAGTDANIRYYNLPADVTYFVQENNSNTTALYAVASPTELAEMKGYLTNIVPNLAIYASSRASASATNTNTDFIAQMNGVQFSDIPFFKDTNSPQYQKLAKSTGGEYQLMRLYAMGADAWLLINQFNELRQVPGYRLSGLTGILSADTNCNVERDMTWYQYQDGAIVPVAN

SEQ ID NO: 4303 - protein, 119 aa, H. influenzae strain 86-028NP
MFSLKRQQGASFEHQARLFLESKGLTFIAANQNFKCGELDLIMNDKETIVFVEVRQRSHSAYGSAIESVDWRKQQKWLDAANLWLAKQNMSLEDANCRFDLIAFGKTPQDIQWIPNFLD

SEQ ID NO: 4304 - protein, 194 aa, H. influenzae strain 86-028NP
MLQKVKDIYSESIQIQIAASSMLSENITNATQMVMQCLLGGNKVIACGVSRSYANAQFLVSNLLNRYDLVRPSFPSVLLSLESAVGSSLVFEQPPEELYCHQFNAIAKSGDLLIAFAPLGTEKIVLNIISHAVSKEVNVIVLTGSNNDAIQGILADKDLEISIPATKESRILENHLFVINALCELVDQTLFPSA

SEQ ID NO: 4305 - protein, 193 aa, H. influenzae strain 86-028NP
MTLSPLKKLAILLGATIFLQGCVAAVIGGGAVAAKVATDPRTTGTQIDDETLEFKVENAVEKDAQIKAEGRVNAVSYNGRVLLIGQVPNSDVKDTATALAKGVEGVNEVYNELTVSPKISFAQISKDSWLTTQVKSKMFVDGRVKATDVKVISENGEVFLLGNVTQSQANAAADIASKISGVKKVIKVFKYLD

SEQ ID NO: 4306 - protein, 756 aa, H. influenzae strain 86-028NP
MNKSLMVTKRDGTQEQINLDKIHRVITWAAEGLDNVSVSQVELRSHIQFYEGIRTSDIHETIIKAAADLISKDSPDYQYLAARLAIFHLRKKAYGHFDPPRLYDHVKKLVRMEKYDQALLDDYTREEWDTMDGFIDHWRDMTFSYAAVKQLEGKYLVQNRVTGEIYESAQFLYLLVSASLFSKYPKETRLDYVKRFYDATSTFKISLPTPIMAGVRTPTRQFSSCVLIECDDSLDSINATASAIVKYVSQRAGIGINAGAIRALGSEIRGGEAFHTGCIPFYKYFQTAVKSCSQGGVRGGAATLYYPIWHLEAENLLVLKNNRGVEDNRVRHMDYGVQLNKLMYQRLIKGGEITLFSPSDVPGLYEAFFADQDKFEELYVKYEQDPTIRKRTVKAVEIFSLLMQERASTGRIYIQNVDHCNTHSPFDPQVAPVRQSNLCLEIALPTKPLQHINDENGEIALCTLSAFNLGKIENLDELEELADLAVRSLDALLDYQDYPVVAAKRSSLARRSLGIGVINYAYYLAKNGVRYSDGSANDLTHRTFEAIQYYLLKASMNLAKEQGACEYFNETTYAKGILPIDTYKKDLDSLTQEPLHYDWESLRKDIQEFGLRNSTLTALMPSETSSQISNATNGIEPPRGHVSIKASKDGILKQVVPEYENLMDNYELLWDIPSNDGYLHLVGIMQKFVDQAISANTNYDPKRFEDGKVPMKVLLKDLLTAYKYGLKTLYYQNTRDGAEDVQEDLDDGCAGGACKI

SEQ ID NO: 4307 - protein, 376 aa, H. influenzae strain 86-028NP
MAYTTFSQNKNDQLKEPMFFGQNVNVARYDQQKYETFEKLIEKQLSFFWRPEEVDVSQDRIDYAALPEHEKHIFISNLKYQTLLDSIQGRSPNVALLPLVSIPELETWIETWTFSETIHSRSYTHIIRNIVNDPSIVFDDIVTNEEIIKRAQDISSYYDDLIRDSQLYGLYGEGTYTVDGKECVVTLRSLKKQLYLCLMSVNALEAIRFYVSFACSFAFAERRLMEGNAKIIKFIARDEALHLTGTQHILNIMAAGQDDPEMAEIAEECKQEAYDLFVAAAEQEKAWADYLFKDGSMIGLNRDILVQYVEYITNIRMQAVGLPLPFQTRSNPIPWINAWLVSDNVQVAPQEVEVSSYLVGQIDSKVDTNDFDDFSL

SEQ ID NO: 4308 - protein, 409 aa, H. influenzae strain 86-028NP
MTIEILVPDLPESVADATVATWHKKLGDTVKRDEVIVEIETDKVVLEVPALSDGVLAEVVQAEGETVVSKQLLGKISTAQEGDVSSATLKATNEPTPSDRQNAAIENSHNHNADQSPAIRRLLAEHDLQADQIQGSGVGGRLTREDIEREIAKRQAQQVKQEAATEQNTISTVAYSARSEKRVPMTRLRKRIAERLLEAKNSTAMLTTFNEVDMQPIMTLRKTYGEKFEKQYGVRLGFMSFYIKAVVEALKRYPEVNASIDGDDVVYHNYFDISIAVSTPRGLVTPVLRDCDKLSMAEIEKQIKALAEKGRDGKLTVEDLTGGNFTITNGGVFGSLMSTPIINPPQSAILGMHAIKERPIALNGQVVIHPMMYLALSYDHRLIDGRESVGFLVTIKELLEDPTRLLLEI

SEQ ID NO: 4309 - protein, 950 aa, H. influenzae strain 86-028NP
MERKYCFKYHNKEVIMQQNKAFDDWLASTALGGANQSYIEELYESYLSDPQSVEESWRKTFDSLPKTTALEQPHTPVRDYFRRLARENHNEAVTVIDPAAGAKLVKVLQFINAYRFRGHLEANLDPLNYYRWKVSSVPELDYRHHGFTEQDLNETFNINHYVYKRDTIKLGELAQMLKETYCGSIGLEFMHVQDMEQKMWLQSKMESLLDKPLFTSEERVNFLRELTAADGLERYLGAKFPGAKRFSLEGSDAFIPLMKEIIRHSSRQGVNDVVMGMAHRGRLNMLVNVLGKKPENLFDEFAGKHSSERTGDVKYHQGFSSDFAVDDKRVHLTLAFNPSHLEIVSPVVIGSVRSRQTRMNDTEHSKVLAITVHGDSAVAGQGVVQETLNMSNARGYSVGGTIRIVINNQIGFTTSNPNDTRSTEYCTDIAKMIQAPIIHVNGDDPEAVAFTARMAVEYRNLFKRDIFIDLISYRRHGHNEADEPLATQPMMYSIIKKHPTPRKVYADRLVSEGVMTEEQVTEMANDYRDALDNGDRVVSEWREMDTAKMDWLQYLNYDWTAPYESKFSQERFLTLAKRVCEYPESLRAHPRVEKIYNDRKAMYQGEKLLDWGMAETMAYATLLDEGVNVRLSGEDAGRGTFFHRHAVVHNQNDGTGYVPLTHLHANQGRFEVWDSVLSEESVLAFEYGYATTDPKTLTIWEAQFGDFANGAQIVIDQFISSGEQKWGRMCGLVMLLPHGYEGQGPEHSSARLERYLQLCAEQNMQVCVPSTPAQVYHMLRRQSLRKMRRPLIAISPKSLLRHPLAVSSLDELINGTFQTVIGEIDELDPKDVKRVVMCSGKVYYDVLEQRRANNQKDVAIIRIEQLYPFPHEDVKKALEPYAHVTDYVWCQEEPLNQGAWYCSKHNFESAIPESVKLKYAGRPASASPAVGYMSLHTKQQKQLVEDALSF

SEQ ID NO: 4310 - protein, 212 aa, H. influenzae strain 86-028NP
MNIEIIPVTAFQQNCSLIWDDDKNAAIIDPGGEAERLIQRIEELDLNLKVILITHGHLDHVGAAMQLKQHFGVEIWGSNEKDKFLFESLPEQAQRFGLPNIEAFLPDRWFNQEGEILKLDGFNFEILHLPGHTPGHIGFIEHEKKVAFTGDVLFQGGIGRTDFPRGDYETLISSIRTKLLPLNDDLIIIAGHGSYTTIGQEKRSNPFLNSKS

SEQ ID NO: 4311 - protein, 251 aa, H. influenzae strain 86-028NP
MLFDSHLHLDQLSDENIQQTLAHSKIIGMLAVSTNLNSAKKLLNLKQTYPKKLYIAAGFHPEQQLPSLEEQKELFQWIDEHYSSISAIGEVGLPHYSKRENPNLDYVPYIELLERFILIAKKWDLPLNLHIVHNDVEIALELLQKHKIQRAHFHWFKTDEKSFQKFFSTPYFASLTPDILWNHKTQYVAQHLPLNRLMIETDSPWQHEGFERAGISEQLLAVLQKLAELKSLPLHSVQKQMLLNTQQFYQL

SEQ ID NO: 4312 - protein, 186 aa, H. influenzae strain 86-028NP
MNYVDQNKRKWLSLGGIALGISILPNSVLAMVSTPKPRILTFRNINTGERLSGEFSLAKGFSPAMLKKLDYLMRDKRTNQVHKMDPNLFHKFYNIQTNLGLRDAEIEVICGYRSVATNAMRRRQSRGVAKNSYHIKGKAIDFRIAGVPLIKVKSSAESLRNGGVGYYPTSNFIHVDTGPVRTWKGV

SEQ ID NO: 4313 - protein, 489 aa, H. influenzae strain 86-028NP
MVVFKSTLKLSLFALSLSMMMSGCVLVGLSKNDQSKSLYGINLSHLSLAERKELEEAIYADQQRLTEEKQTLLNMTLTHEIGDHKLQFKPLLARLYASRKYAPLWTDNAAARQLLRDYAAMVASGISKSSATSLETLALVEQQGGLVYDVLLSDILLDYLYYTQNVRSQASNWLYSSAQYQAQQPENDHIQRWLSAVENNQLLDFIQSLAGENHLYRQTVQSLPMFIPTSKESNIAQKLAMNAQRLRVIPDFHNGIFVNIPSYKLQYYRDGDLILESRVIVGTDSRRTPVMYSKLSNVVVNPPWNAPIRLINEDLLPKMKADPNYITEHNYSILDNQGNVVDPASIDWESIGNKFPYRVRQAAGDSALGNYKFNMPSSDAIYLHDTPNRGLFNRKNRALSSGCVRVEKSDQLASILLKEAGWTETRKNTVLASKKTTSAPIRSDNPVFLYYVTAWIENGNIVNLPDIYGYDRQINLAEINWDLVKKYLQ

SEQ ID NO: 4314 - protein, 695 aa, H. influenzae strain 86-028NP
MVMKFKMSKNVICYAWLSVCLSSAIPAFAVQPTLKPSDISIPAISEESQLATKRATTRLTQSHYRKIKLDDDFSEKIFDRYIKNLDFSHNTFLQSDIDELRQKYGTKLDEQLSQGDLSAAFDIYDVMMKRRYERYTYALSLLDKEPDLNGQDQIEIDREKAAAPQTEADANKLWDARVKNDIINLKLKDKKWSEIKAKLTKRYNLAIRRLTQTKADDIVQIYLNAFAREIDPHTSYLSPRTAKSFNESINLSLEGIGTTLQSEDDEISIKSLVPGAPAERSKKLHPGDKIIGVGQATGDIEDVVGWRLEDLVEKIKGKKGTKVRLEIEPAKGGKSRIITLVRDKVRIEDQAAKLTFEKVSGKNIAVIKIPSFYIGLTEDVKKLLVKLENQKAEALIVDLRENGGGALTEAVALSGLFIADGPVVQVRDAYQRIRVHEDDDATQQYKGLLFVMINRYSASASEIFAAAMQDYRRGIIIGQNTFGKGTVQQSRSLNFIYDLDQSPLGVLQYTIQKFYRVNGGSTQLKGVAADINFPEIIDAKEYGEDKEDNALAWDKIPSASYTEVGNIDYIDNAVNILNEKHLARIAKDPEFVALNEELKVRNERRDRKFLSLNYKMRKAENDKDDARRLKDLNERFKREGKKALKDIDDLPKDYEAPDFFLKEAEKIAADFVIFNSDQKINQANGLSEAKTESKK

SEQ ID NO: 4315 - protein, 212 aa, H. influenzae strain 86-028NP
MTDTQLSSQVTDVQTEVQKLTNAKAIITYLAEKFPLCFVLEGEAKPLKIGLFQDLAEALQDDERVSKTQLRQALRQYTSNWRYLYGCREGAVRVDLQGNPAGVLDAEHVAHAAQQLAEAKARFAEKRKAEAVAKKAQQKKHPRKPANKNLKKESKLSLSAVDFSQISVGSVVKVKAGDNAKKATVVEVLKDSARVELENGLIMNVAADRLFA

SEQ ID NO: 4316 - protein, 416 aa, H. influenzae strain 86-028NP
VPKTKLTSPPFKILKCTECDACINVPSILQSNEQAECPRCHHLLESSTRWSLHRCAMIALSILILMPFSLNYPLLSLHLLGIKIDASIWDGIWKMAVGGYEYTAFMIFICAVVMPITFALLVIMLWLAKIFQIKPRSVLLFLGYIKAWVMFDVYLVALGVTIFKVREYATLEINIYLIPFIFTALLTTLLFIKLNLSALWQEFYPECTSVYTKQAVELCPACHYTFTQKSIYYDHQQKICCPRCQSPLNTSDKLKLQATWATLIAGIIMLFPANLLPISGIYLTGALSEDTLISGVISFVKSGSYFVAFVVFFASIFVPISKIFIMLYLLACVHFKWQHSIKWQMRLLHLVHFVGRWSMLDLFVLALMMSLVTRGEIINFTVGPGAFYFGAAVFCTMLSTSQFDSKLIWKIYDREK

SEQ ID NO: 4317 - protein, 881 aa, H. influenzae strain 86-028NP
MTEKNNSSSIEEKYQEITANLRKTKRISPFWLLPFIALCIGAILFFQIVKERGTSITITFTNGSGIVADKTQIRYQGLQIGIVKEVHFTDNLQKVEVVANINPEASSILRENTKFWLVQPNVSLAGISGLDSLVSGNYITLQPGDGDREDEFIAEEQGPIAQVSAGDLLIHLISDDLGSISIGASVYFKKLPVGKIYDYRINKNNKVEIDVVIDKAYAKFVKKDSRFWNVSGINANISPSGLNLNVESLNAVVQGAVSFDSPADSPKADENSHFTLYTNLKAAKRGIEIKVTIPASSALIAGQTEVYSQDNAIGILAKLSAVENNDEILEGSLLIDPNQASLFKANSKIVLRNKKMDLGNLAEPKKFFRDEYFDVIAGDGETKHQFNVIKENELLLNAPNTLVLTLTAPENYGVSEGQNVFYNNMIIGQIVSQTIDVNGVQFKAAIASEYRNLIHEDTQFVAATNFDISIGLDGLRFESATPEKWLQGGVRVLTKQAQGKAKTSYPLYQNISNAEHGITGDILTPTITLHTQTLPSIDKGSLVLYRQFEVGKILSIKPKTNSFDVEIYIYPAYQHLLTDKSRFWVESAAKIDVSPKGISIQATPLARSLKGAISFDNGGSGNNRTLYANESYAKSIGFVITLITDDATNLSKGMNLRYLGLDVGQIDSIHLDAKAKRITAKALINPNYMNIIAKEGANFTIISPQISAGGIDNLDSLLQPYIDIEIGNGNTKTQFNLAQTAPQRNKFSNGTPFILETRDAMNLSEGSPILYRGVEVGTVKKFELNSLGDRVLVHIAIMPKYSHLVRQNTEFWIASGYDFSLGWKGAVFNTGSVQQLLKGGISFSTPAEKEIQPQAQPNKRFLLQINRPEEVQTWGSGALSK

SEQ ID NO: 4318 - protein, 150 aa, H. influenzae strain 86-028NP
MTDIQISVQEQPFDQNAVYQWLSEQHSVGATVIFVGKVRDLNLGDAVSSLYLEHYPAMTEKALNEIVAQATARWDIQRVSVIHRVGLLQTGDEIVLVGVSSAHRGDAYHANEFIMDFLKSKAPFWKKEQTNQGERWIEARESDKEALEKW

SEQ ID NO: 4319 - protein, 81 aa, H. influenzae strain 86-028NP
MLNILFFAQTRELIGVDAIQLEDDFATAEAVREHLAQKGDKWALALEKGKLLVAINQTLMPLESAVKNGDEIAFFPPVTGG

SEQ ID NO: 4320 - protein, 160 aa, H. influenzae strain 86-028NP
MTTFTHINSQGEANMVDVSAKAETVREAHAEAIVTMSKETLAMIVEGKHHKGDVFATARIAGIQAAKRTWELIPLCHPLLLSKVEVNLEPLLETNQVRIQSLCKLTGKTGVEMEALTAASVAALTIYDMCKAVQKDIVIEQVRLLEKCGGKSGHFIAEEK

SEQ ID NO: 4321 - protein, 337 aa, H. influenzae strain 86-028NP
MQSIPIKNVGESRLVDPFQRQYYYLRLSITDQCNFRCTYCLPDGYQPEANKPSFLTLKEIIHLAQAFAEMGTEKIRLTGGEPTLRKDFISIAESIANIDGIRQLAVTTNGYRMAKDVADWKQAGITSINVSVDSLDPKMFHQITGINKFDDVMRGIDRAFEVGYNKVKVNSVLMKNLNDKEFEQFLAWVKHRPIQMRFIELMQTGEMDSFFDRYHLSGQILADKLLKNGWTLQHKSHTDGPAKVFTHPDYAGEIGLIMPYEKNFCASCNRLRVSAKGKLHLCLFGEEGIELRDLLQSHEQQAILQARIFAALQGKREHHYLHIGDTGVRNHLASIGG

SEQ ID NO: 4322 - protein, 157 aa, H. influenzae strain 86-028NP
MSFAQQKLSELAVSIPGATKIFREYDLDFCCGGSVLLEVAAQQKNLNLAEIEKRLTDLQQNKAENNDKDWTSASYAEMIDHIITRFHNRHREQLPELITLAEKVENVHSDRDDCPIGVTAQLEKIYAELSQHLMKEEQILFPMIKMGIMLWPQCQFV

SEQ ID NO: 4323 - protein, 65 aa, H. influenzae strain 86-028NP
MEMEHDEAGQDVEVIKSLTNNCTPPADACFSWKALYSGINEFIDDLMHHIHLENNILFPRVLNEK

SEQ ID NO: 4324 - protein, 337 aa, H. influenzae strain 86-028NP
MPNFSFVFFYDSAKITPISTALLGRKMNYLKIAQDSLSVESNALLQLSQRLGEDFNQVIDLILACEGRLVIGGIGKSGLIGKKMVATFASTGTPSFFLHPTEAFHGDLGMLKPIDIVMLISYSGETDDVNKLIPSLKNFGNKIIAVTSNKNSTLARHADYVLDITVEREVCPNNLAPTTSALVTLALGDALAVSLITARNFQPADFAKFHPGGSLGRRLLCKVKDQMQTRLPTILPNTNFTDCLTVMNEGRMGVALVMENEQLKGIITDGDIRRALTANGAETLNKTAKDFMTSSPKTIHQDEFLSKAEDFMKAKKIHSLVVVNDENHVVGLVEFSS

SEQ ID NO: 4325 - protein, 180 aa, H. influenzae strain 86-028NP
MQQKLENIKFVITDVDGVLTDGQLHYDANGEAIKSFHVRDGLGIKMLMDAGIQVAVLSGRDSPILRRRIADLGIKLFFLGKLEKETACFDLMKQAGVTADQTAYIGDDSVDLPAFAVCGASFAVADAPIYVKNTVDHVLSTNGGKGAFREMSDMILQAQGKSSVFDTAQGFLKSVKNMGQ

SEQ ID NO: 4326 - protein, 1492 aa, H. influenzae strain 86-028NP; identical to SEQ ID NO: 672

SEQ ID NO: 4327 - protein, 545 aa, H. influenzae strain 86-028NP
MKNIKSRLKLSAISVLLGLASSSLYAEEAFLVKGFQLSGALETLSEDAQLSVAKSLSKYQGTQTLTNLKTAQLELQAVLDKIEPNKFDVILPQQTITDGNIMFELVSKSAAESQVFYKASQGYSEENIARSLPSLKQGKVYEDGRQWFDLREFNMAKENPLKVTRVHYELNPKNKTSNLIIAGFSPFGKTRSFISYDNFGAREFNYQRVSLGFVNANLTGHDDVLNLNALTNVKAPSKSYAVGVGYTYPFYSKHQSLSLYTSMSYADSNDIDGLPSAINRKLSKGQSISANLKWSYYLPTFNLGMEDQFKINLGYNYRHINQTSELNTLGATKKKFAVSGVSAGIDGHIQFTPKTIFNIDLTHHYYASKLPGSFGMERIGETFNRSYHISTASLGLSQEFAQGWHFSSQLSGQFTLQDISSIDLFSVTGTYGVRGFKYGGASGERGLVWRNELSMPKYTRFQISPYAFYDAGQFRYNSENAKIYGEDMHTVSSAGLGIKTSPTQNLSLDAFVARRFANANSDNLNGNKKRTSSPTTFWGRLTFSF

SEQ ID NO: 4328 - protein, 650 aa, H. influenzae strain 86-028NP
MTKENLQNTPQNTTVSLVESNNNQTSPQMLQQSPKPSLLRLEQHIEKKDYEFACRELMVILEKMDANFGGVHDIEFDAPAQLAYLPEKLLIYFATRLANAITTLFSDPELAISEEGALKMISLQRWLTLIFASSPYVNADHILNKYNINPDSEGGFHLATDNSSIAKFCIFYLPESNVNMSLDALWAGNQQLCASLCFALQSSRFIGTASAFHKRAVVLQWFPKKLAEIANLDELPANILHDVYMHCSYDLAKNKHDVKRPLNELVRKHILTQGWQDRYLYTLGKKDGKPVMMVLLEHFNSGHSIYRTHSTSMIAAREKFYLVGLGHEGVDKIGREVFDEFFEISSNNIMERLFFIRKQCETFQPAVFYMPSIGMDITTIFVSNTRLAPIQAVALGHPATTHSEFIDYVIVEDDYVGSEDCFSETLLRLPKDALPYVPSALAPQKVDYVLRENPEVVNIGIAATTMKLNPEFLVTLQEIRDKAKVKMHFHFALGQSTGLTHPYVKWFIESYLGDDATAHPHAPYHDYLAILRDCDMLLNPFPFGNTNGIIDMVTLGLVGVCKTGDEVHEHIDEGLFKRLGLPEWLIADTRETYIECALRLAENHQERLELRRYIIENNGLQKLFTGDPRPLGKILLKKTNEWKRKHLSKK

SEQ ID NO: 4329 - protein, 718 aa, H. influenzae strain 86-028NP
MNIRLNAKVISTIPVFIAVNIAAVGIWFFDISSQSMPLILGIIAGGLVDLDNRLTGRLKNVFFTLIAFSISSFIVQLHIGKPIQYIVLMTVLTFIFTMIGAVGQRYSTIAFGSLVVALYTTLTYIPEVNVWFINPVMILCGTLLYSVVTLIVYLFFPNRPVQESVAKAFCALGEYLDTKSCFFDPDEVAEIEKKHLNFAMKNANVVTAFNIVRTALFYRIRGQHRHPRTQRMLRYYFAAQDIHERANSTHFDYQQITEKLKNTDLIFRIQRLLELQAQSCKEITASLRENKPYHFNERVERALLGTLHSFELYRTQHLNDQDELIDIQTLLDNLQSINWQLRQLAQETTDTEQLAQIHTEQITGLKNISAVIFSHFTFESPLFRHAVRLSIVVFLCCAIVEFFQFNLGYWILLTTVFVCQPNYSATKVRLRQRIIGTILGVVVGSLLPYLNPTLELKQGLVVLTSTLFFFFRSNNYSFSTFFITLQVLLSFDVMGFDTAAALMPRLLDTLLGAAISWFAVSYLWPDWKYLQLDKVSHQALRSDAVYLLHIISQLQFGKSDDLKYRIARRNAHQYAAALSTTLSNMNNEPVKYKAYLQKGFDLLKLNYSLLSYISALGAYRDRMKNLQQTAQFLSGFYPVAKKIIYTLEHIEEIPEAIFNQQQESIETHLKELEKQDMTAEERAVFSLPYQQLNLITQLLPQFYGYFKKEINCERAGAL

SEQ ID NO: 4330 - protein, 221 aa, H. influenzae strain 86-028NP
MKLRAVVLGLATLCTSTATFAGMVSTSSNLEFLAIDGQKASKSLGKAKTFTVDDTQSHQVVVRLNEIVGSGSNQSLFESNPVIVTFQGNAEDLVISAPAIRNLDSGDKFNQMPNITVKTKSGNAISAKVDVLKQEGLFPSGNVLNDLAEYNASGAAASVSKFTATTSANSMVAVPAGNAKANKGKVVVQGENVAEQQLQYWFQQADKETQTRFLNWAKSHK

SEQ ID NO: 4331 - protein, 353 aa, H. influenzae strain 86-028NP
MLNDILTGYGIFILEILTILLLILAIVGLIISYRQHNKSKVGELEIKDLSEEFNEQVRLLRDFNLSEEEQKQRTKAEKKAEKQNAKKRKEKLKKGDTLEDEKKACVYVLDFCGDISASETTALREEISAILNVAKPEDEVLLRLESPGGIVHNYGFAASQLSRLKQKGIKLTVAVDKVAASGGYMMACVADKIVSAPFAVIGSIGVVAQIPNVHRLLKKHDVDVDVMTAGEFKRTVTVLGENTEKGKQKFQQELEETHKLFKQFVSQNRPCLDIDKIATGEHWFGQQAIALQLVDEISTSDDLILEKMKEKQVLNVKYRLKKSLIKKFGRQAEESAINIIHRYSTKQSRDFMY

SEQ ID NO: 4332 - protein, 192 aa, H. influenzae strain 86-028NP
MTHYILLIIGTALINNFVLVKFLGLCPFMGVSKKIETAVGMGLATMFVLTVASLCAYLVDHYILIPLNATFLRTLVFILVIAVVVQFTEMAINKTSPTLYRLLGIFLPLITTNCAVLGVALLNVNLAHNLTESVVYGFGASLGFSLVLVLFAALRERLVAADIPATFRGSAIALITAGLMSLAFMGFTGLVK

SEQ ID NO: 4333 - protein, 193 aa, H. influenzae strain 86-028NP
MTFLFIVITLLALIFGAILGFASIKLKVEADPVVEKIDAILPQSQCGQCGYPGCKPYAEAICNGDEITKCIPGGQTTIVKIAEILGVDVPTMEGIEEPIEKVAFIDENMCIGCTKCIQACPVDAIIGTNKAMHTIIPDLCTGCELCVAPCPTDCILMIPVKKNIDNWDWKFDAKLVIPVMNVDGSEKKLVVGE

SEQ ID NO: 4334 - protein, 665 aa, H. influenzae strain 86-028NP
MADVLSRFNSGKLWDFKGGIHPPEMKSQSNSQPLRHLPLGTDFYIPLKQHLGTTGNLLIKEGDYVLKGQALTKGDGLRMLPVHAPTSGTIKSIKPYVATHPSGLDEPTIHLQADGLDQWIERNPIDDFSTLSPEQLIHKIYQAGIAGLGGAVFPTAAKIQSAEQKVKLLIINGAECEPYITCDDRLMRERADEIIKGIRILRYILHPEKVVIAIEDNKPEAISAIRTALQGANDISIRVIPTKYPSGATKQLIYLLTGIEVPSGARSSSIGVLMQNVGTMFAIKRAIINDEPLIERVVTLTGNKIAEKGNYWVRLGTPISQILSDAGYQFDKHFPIFAGGPMMGLELPNLNAPVTKLVNCLLAPDYLEYAEPEAEQACIRCSSCSDACPVNLMPQQLYWFARSEDHKKSEEYALKDCIECGICAYVCPSHIPLIQYFRQEKAKIWQIKEKQKKSDEAKIRFEAKQARMEREEQERKARSQRAAQARREELAQTKGEDPVKAALERLKAKKANETEPTQIKTLTSEKGEVLPDNTDLMAQRKARRLARQQAASQVENQEQQTQPTDAKKAAVAAAIARAKAKKLAQTNSTSEAISNSQTAENEVEKTKSAVEKTEENSTALDPKKAAVAAAIARAKAKKLAQANSTSEAISNSQTAENEVEKQIVR

SEQ ID NO: 4335 - protein, 358 aa, H. influenzae strain 86-028NP
MFKMVSSPHTHSGKLTAHIMLWVILAMMPAFFTQIYYFGFGVVLQSALAIGTAIIAEFIAIKLRGKKPLNYLSDFSVALTALILAMAIPPYAPYWIIIIGTLCAVLLGKQVYGGLGQNPFNPAMIGYVILLISFPLQMTTWMPPINLLQEPPTFSDTFSLIFSGLTTDGFTLSQLTHNIDGITQATPLDSAKIFYKSHNQLSDFYELIKLPIFMGNGTDFAQGWWQINVAFLAGGIFLILKRIIHWQIPVAMLVTFFCLATATAFTGFTHLSAISQLVSGAMMFGAFFIATDPVTASITPRGKIIFGALVGLFVYLIRYHGNYPDGVAFAILLSNICVPLIDHYTRPRVSGYPTKGRK

SEQ ID NO: 4336 - protein, 207 aa, H. influenzae strain 86-028NP
MGTVKITSRYGILLGFIALLCTIISTGIFFLTKDKIDAVIAAQQRELLLQVIPQDYFNNNLLESAVIPQDKNFVGIQKIYFAKKDGNISAYAYETTAPDGYSGDIRLLVGLDPKGEVLGVRVIEHHETPGLGDKIERRISNWILGFTNQSINEHNLSEWAVKKDGGKFDQFSGATITPRAVVNQTKRSALIMLNNQALLQQLSTQVK

SEQ ID NO: 4337 - protein, 235 aa, H. influenzae strain 86-028NP
MTDLTEKNTALEEEKIESAVENQQKSIWKEIFAQGIWKNNPAVVQLLGLCPLLAVSSTATNALGLGLATMLVLTCTNTVISLFRQYIPKEIRIPIYVMIIATTVTAVQLLMNAYTYTLYQSLGIFIPLIVTNCIIIGRAEAFASKNSLLHSIWDGFSMGLGMALSLTILGALREIIGQGTIFEGIENLFGEQAKFLTHHIYHTDSSFLLFILPPGAFIGLGLLLAIKNRIDNVKK

SEQ ID NO: 4338 - protein, 211 aa, H. influenzae strain 86-028NP
MNKTKRIEILTRLREQTPHPTTELQYNSPFELLIAVILSAQATDKGVNKATEKLFPVANTPQAILDLGLDGLKSYIKTIGLFNSKAENIIKTCRDLIEKHNGEVPENREALEALAGVGRKTANVVLNTAFGHPTIAVDTHIFRVCNRTNFAAGKDVVKVEEKLLKVVPDEFKVDVHHWLILHGRYTCIARKPRCGSCIIEDLCEYKEKVEF

SEQ ID NO: 4339 - protein, 457 aa, H. influenzae strain 86-028NP
MTTNNKQRQTWSSRLTYVMTVAGATVGFGATWRFPYLVGENGGGAYVLLFCIAMIVIGIPMILVENVIGRRLRVNSIDAFGDKILDKGKGISKYWKILGYMGLLGAFGIMAYYMVLGGWVISYIISLISGTLDISTPITKDIAKNFYDLHIGNSPYEIIFYTLLFVIVNYIILAKGIIGGIERSVKYLMPLLFIFLIGMVIRNVTLPGAMEGITFYLKPDFSKITPQLFIFVLGQVFFALSLGFGVLITLSSYLNKEENLIHTAVITGFTNTIIAVLAGFMIFPSLFTFGIEPNAGPTLVFQSLPIVFSHLWAGKFFAIIFFGLLLIAALTTSITIYEVIITALQEKLRMRRGKAIVLTLSGIFLLGNIPAILGDNLWKNVTIFGKSIFDFYDYASGNILFMLTALGCAIFVGFVLKDEAKKELSSTKYSTFIKIWFNYVKFVVPLIILVIFISNLF

SEQ ID NO: 4340 - protein, 351 aa, H. influenzae strain 86-028NP
MLQINVKKQLGKLALQANIQVPDQGVTAIFGLSGSGKTSLINLVSGLIQPDEGFIRLNDRTLVDMESQESLPTHLRKIGYVFQDARLFPHYTVKGNLRYGMKHVSQDDFNYIVDLLGITHLLKRYPLTLSGGEKQRVAIGRALLTDPDILLMDEPLSALDVPRKRELMQYLERLSKEINIPILYVTHSLDELLRLADRVVLMENGIVQAYDSVEKIWNSPIFAPWKGENEQSSVLALPVHLHNPPYKMTALSLGEQALWIHQVPANVGERVLVCIYSSDVSIILQKPEQTSIRNILRGKITQIEIQDSRVDLAVLVEGNKIWASISKWAQNELRFAVGQDVYVQIKAVSVM

SEQ ID NO: 4341 - protein, 229 aa, H. influenzae strain 86-028NP
MEISAINLSLSVAVSSMLWSLPLAIFVAWLLARKNFYGKSLITGVIHLPLVLPPVVIGYLLLVAMGRNGFIGKYLYQWFGLSFGFSWKGAVLSSAVVAFPLVVRAIRLSLENIDIKLEQAAQTLGASAWRVFFTITLPLSLPGVLAGLVLGFARSLGEFGATITFVSNIAGETQTIPLAMYSFIQTPAAEEQTARLCLFAIILSLISLLLSEWLSKRMQKKLGQGNVAN

SEQ ID NO: 4342 - protein, 254 aa, H. influenzae strain 86-028NP
MKKLTKISTALLIAGLGFSFAASAKVTVFAAASMTDALQQVAKDYAKQNPKNEVVFSFASSSTLAKQVEEGAPADIFVSASNKWMKYLSEKDLTVKETEKVLVGNDLVLIAPAKSAVNSVDIAKGEWINALKDSYLSVGDPAHVPAGQYAAEALTKLNLWDKVQDRLARAKDVRGALALVERAEAPYGIVYSTDAKVSQQVKTVAVFPADSHKPVVYPVSIVKGHDNADSRDFLKYLESDAAKKVLVGYGFSAK

SEQ ID NO: 4343 - protein, 255 aa, H. influenzae strain 86-028NP
MKNTEILLTIKLQQALFIDPKRVRLLKEIQQCGSINQAAKNAKVSYKSAWDHLEAMNKISPRPLLERNTGGKNGGGTVLTTYAERLLQLYDLLERTQEHAFHILQDESVPLDSLLTATARFSLQSSARNQFFGRVAQQRIIDSRCVVDVNVQGLPTPLQVSITTKSSARLKLITEKEVMLMFKAPWVKISEQPLVNQPNQFSVNIKSLNEEEAILQFAESNIEFCATVHQPNQWQIGQQVWIHIDQEQIILATLG

SEQ ID NO: 4344 - protein, 267 aa, H. influenzae strain 86-028NP
MKFSVLMSLYIKENPQFLRECFESLVAQTRQADEIVLVFDGVVTPELESVVTEFETKLPLKLVKLPQNRGLGKALNEGLLHCTYDWVFRMDTDDICVPDRFEKQVAFIEQHPESIIFGGQIAEFGKNVNDIVAYRNVPTSAQEIIKFTQKRCPFNHMTVAYQKSAVINCGGYEDLQEDYYLWIKLVAQGLYMANLPDILVYARVGNGMVSRRRGVNQAKAEWRLFKLKYRLGIQGLLSGLFTFALRFGSRLLPTSLLKKLYQTFLRK

SEQ ID NO: 4345 - protein, 294 aa, H. influenzae strain 86-028NP
MLSIIVPSYNRKAEVPALLESLTQQTSSNFEVIIVDDCSKERVVVEQSYSFPVTVIRNETNQGAAESRNVGARTSKGDWLLFLDDDDRFMPEKCEKILQVIEQNPDINFIYHPAKCEMVNEGFTYVTQPIEPQEISTERILLANKIGGMPMVAIKKEMFLKIGGLSTALRSLEDYDFLLKLLQEPSFTPYKINEPLTYCTFHTKRSSVSTDTTNTQKAIDYIREHYVKTVEQARNFDINASYILAYPHIMNLSRKAAKYYFDIFKKTKSIRQFIITLVILISPKLAINLKRLGK

SEQ ID NO: 4346 - protein, 257 aa, H. influenzae strain 86-028NP
MLKKYLISLDKDIQRRKLFFSQKNTEDFQIFSAINTMQKDWDELASIFNIEQFKAHYFRNVTKGEIGCTLSHLSVYQKIIEDNDIAEDSYALVCEDDALFHSDFQQNLTALLSEKLEAEIILLGQSKINNFNDTDLEINYPTTFSFLCKKTGNVNYAFPYKSYFAGTVGYLIKKSAARRFIQQISQNKPFWLADDFLLFEQNFNIRNKVVRPLMVIENPVLISNLESVRGSLSNNLLKKLMKYPLKKIFAIKKNLAN

SEQ ID NO: 4347 - protein, 353 aa, H. influenzae strain 86-028NP
MKKIGFFIMNIESAGGTERVSINVVNALAKQGYDVSFISIGGNKPFFQVDEKINIYPMNKLPYSLKKDYFSITKKLRELVKELQLDTLIVVDGAIMLFSALALVNLNIKHILWEHYSFNFTGNRLVRTLGKYLAVTTCDKIVTLTEAEKTLWQEKFKTNNIISIANPNTLLPKNKLAKWENKTVLSVGHLFSYKGFDYLLKVWQVLAKKYPDWNLKIAGSGEEEENLKNLAKALNIEDSVNFIPRTNDVAFYYESSSIYCLPSQTEGLPLVVIEAMAFGLPIVAFNCSPGVKQLVEHKENGFLCEQNNIEEMVKGLDLLINNPELYQQMSDKSRLMSEDYGIEKIIEEWKGIL

SEQ ID NO: 4348 - protein, 304 aa, H. influenzae strain 86-028NP
MNLILCCTPLQVLIARKIIELHPNEQFFGVMFGRVWDKKRTLYASKLAEVCSDSMNIDTGKDLKGFDFLKLMRQLKNKITHKGFDKVFLANLNSLWLQTYLSHVSFKELYTFDDGSDNIFPHPNLLREPDTFKYKLIKAFIGDKYSVNKLFKKIKKHYTVYPNYKNIVSNIEPISLWDNQIDCEIDGEVSFFIGQPLLNTKEENISLIKKLKEQFSFDYYFPHPAEDYRVDGVNYVESELIFEDYVFKYLSNKIIIIYTFFSSVAFNLLSHPNVEIRFIRTSIPRWQFCYDSFPDLGLKIYKEI

SEQ ID NO: 4349 - protein, 401 aa, H. influenzae strain 86-028NP
MKVFKDSAIYLVGELSSKLVPFLLLPYLSRKLGVEGYGSLSYYQTFLSLFLIVVSLTQEGAISRYFYFYGKRSLNLVVNTGYAYTTIIGSIILMGCWIAQSEILFYAALSSIFQSFLNVQLSVRQCQKKAWSYAFIQFSLTVTGAVFTVALLEYYQNNLVEKRILAILLSNLVVWFFSYFLYRKSTTSKKYQFKHYQSALFYILGFGLPLILHYASFFLKGQLDRIFIYHKFSETDLGLYAMGAQLALIVSIAIQALNKAIIPYFYEALKQKKLVIQQLHKWALFSFLLIPIPALIMWIIPEDVLVWILGSQFVGTKYYFILFLISTTLSIPYLILVNYLFYYGKNKLISQCSVLSTIIYVASLVALTFTEIKYIPYAGIIGSLSIIPILYFMTSKVSKTL

SEQ ID NO: 4350 - protein, 247 aa, H. influenzae strain 86-028NP
MLELGKLLTTLIAPPLNTFVLLIIAAIIYCVHFKKLAKFLAIISFTWLYIMSVPFTGLLLTNNDDSPALTLDEYKQAQAIVILGGGSYQTKELYAETASGAPQLERLRYAAFLQKETGLPILTTGYSLIGISEGDLMAKELNQFFNVPTQWIENKARNTEENASFTKNILVKDHIQKIILVTNQWHMKRAKYLFEKQGFDVLPAAAASYGSKGNLSAKSFIPDLGALNSNMVLLKEWIGYWKAHYVE

SEQ ID NO: 4351 - protein, 358 aa, H. influenzae strain 86-028NP
MINTLDRYIGKSILGTIFATLMTLVGLSAIIKFVEQFRSVGKGTYDIWQAVIFTGLTIPKDIETFFPMAALLGALIALGNLASRSELVIMQSAGFSRFKIGIAVMKTALPLVVFTMIIGEWGIPQTEQFARDMRAKALSGGSILSIKNGVWAKDGHHFVFVRRVTDDTKLDDIYIYTFDQQHNLIKLKHANQASYSEDEAKWTLRQVNHSTIMKDEIITTNHLSETWETSLTPDKLGAVSLRPTSLSISGLYHYISFLRETGQDVSRFELTFWRKIFQPVSVGVMMLLALSFIFGSLRSVTAGARIVTGICVGFLFYVVNEILGQTSVVYGIPAIFGALIPSLLFIVMIWWLLSRKRD

SEQ ID NO: 4352 - protein, 367 aa, H. influenzae strain 86-028NP
MILIRYLIKEVFKSQIAILLILLLIFFSQQFVRVLGAAANGNVPADLVFSLLGLGMPTMAQLMLPLCLFIAILLTFGRLYAESEITVMRACGVGQRILVKVALIMSLLTAGIAAYNALWLSPWAIQKQVNMVEDAKANPTVGVLSSGQFISTNNNNVVLFIDKIKDNQIRNVYLFQMTPQKQTKPSVITAEKGELIALPNGDQVLNLKNTKRVEGTSALPDFRITHFDEYHAYLGYQSAENTNDEVAELTLSQLIDLDSSSAKAELHWRITLILAVPLMALIAVPLSRVNPRQGRFAKILPALLLYLIYFLLQSSFKSAGSAGKLEAELLMPLVNIGFFLLAVVLNSWDSEIMYKFRYLFSKKGSAK

SEQ ID NO: 4353 - protein, 491 aa, H. influenzae strain 86-028NP
MKYQAKNTALSQATDCIVLGIYENNKFSKSFNEIDQLTQGYLNDLVKSGELTGKLAQTILLRDLQGLSAKRLLIVGCGKKGELTERQYKQIIQAVLKTLKETNTREVISYLTEIELKDRDLYWNIRFAIETIEHTNYQFDHFKSQKAETSVLESFIFNTDCNQAQQAISHANAISSGIKAARDIANMPPNICNPAYLAEQAKNLAENSTALSLKVVDEEEMAKLGMNAYLAVSKGSENRAYMSVLTFNNAPDKNAKPIVLVGKGLTFDAGGISLKPAADMDEMKYDMCGAASVFGTMKAIAQLNLPLNVIGVLAGCENLPDGNAYRPGDILTTMNGLTVEVLNTDAEGRLVLCDALTYVERFEPELVIDVATLTGACVVALGQHNSGLVSTDNNLANALLQAATETTDKAWRLPLSEEYQEQLKSPFADLANIGGRWGGAITAGAFLSNFTKKYRWAHLDIAGTAWLQGANKGATGRPVSLLTQFLINQVK

SEQ ID NO: 4354 - protein, 669 aa, H. influenzae strain 86-028NP
MTKRTSFNPLVIGVTLFFILLLMAMIFIAPEQTQALLNQAKSGIFANFSWFYVLTFSVFLGFLLILSVSSLGNIKLGQDEEEPEFSFLSWLAMLFAAGMGVGLMFFGVAEPLTHYLSDITVGSAEHKQQEALLHTLFHWGIHAWAVYGTIALALAYFGFRYKLPLALRSCFYPLLKDRINGKIGDAIDVMALLATLFGIITTLGFGSSQLGAGLEQIGWISQNSFALQVGVIVVVMCLAVFSAISGIGKGVKILSEINLTLAFCLLLFVLISGPTLYLLSAFSDNIGNYFSNLVQLSFKTYAYEQEHTSWFSGWTVLYWAWWCSWAPFVGLFIARISKGRTIREFIFGVLVIPSLFGILWFTVFGNTAVWLNDGIAAGGLGEFISSPEILLFKFLNYLPLPTITGFVSLLVISLFFITSADSGIYVLNNIASRDKSLASPAWQAIMWGTLMSVVAIVLMQSGGLANLQTMTLIVALPFALLMLVMCFSLWKGLIADKKYFSTKVNPTSIFWSGDKWKSHLEQMMNQTQEKDILRFLKNTALPAMRELRQELTGKYNLSVEINTLFEQEEPALELVIHKESMRDFMYGIKSVGREVSEQLINDENLPHIQHSVTYEPYTYFFDGRVGYDVQYMDQDELIADMLKQYERYLSLLDDVGQELMAHEQTELAE

SEQ ID NO: 4355 - protein, 451 aa, H. influenzae strain 86-028NP
MKNRSLTLRLISVLCLTALFVWLGSTLVAWWQVRHDVNKVFDAQQVLFAERLANSDLSTILLESSTTLNKNSQSVLKKSYDDDALAFAIFSKTGKLLFSDGRNGKDFIFNYKTGFYNANIYDDDDKWRIFWRMAANGELVIAVGQELDYREDLIEEMILGQMWIWFASLPILIIVLGWLIHKELRPIKRLSQEVQTRKSGDVSLLNTEGLPVEILPLVKNLNQFFDRTSAMLQRERRFTSDAAHELRSPLAALRIQTEVAQLAGDDVALREQALLHLTQGIDRASQLIEQLLTLSRLDNLQALETLQLLDWEAIVQSLISERYFVAEKRKITLVFEKESEPKQKQGQSILVSLMLRNLLDNAIKYCPEDTIVSVKISSSQIIIEDNGGGVEPEDLKKLGQRFYRPAGQNEKGSGLGLSIVMRIAELHGFKVRLENVVKEGRRIGLKAIISL

SEQ ID NO: 4356 - protein, 221 aa, H. influenzae strain 86-028NP
MRILLIEDDNLIGNGLQIGLTKLGFAVDWFTDGKTGMAALTSASYDAVVLDLTLPKLDGLDVLQQWRSNHQDVPVLILTARDTLDERVKGLQSGADDYLCKPFALAEVAARLQALIRRRYGYHHSVIEQAGVKLDQNQRSVWLNNQPISLTSREYKLLELFMLNKDCVLSRSSIEEKLSSWDEEISSGALDVHIYNLRQKLGKQFIRTVHGVGYALGQVEK

SEQ ID NO: 4357 - protein, 121 aa, H. influenzae strain 86-028NP
MKKFALATIFALATTSAFAGFNGNNSQGGFQQTAPAAISVKQALSAADNSMITLVGNITQQIDDDEFWFTDGTGQIKIEIKKRVWNGLNVDSKDKVKIYGKLDNEAFEKAELDVLRVEKAE

SEQ ID NO: 4358 - protein, 166 aa, H. influenzae strain 86-028NP
MGLFDKLFGSKENKSVEVEIYAPISGEIVNIEDVPDVVFSEKIVGDGIAVRPIGNKIVAPVDGVIGKIFETNHAFSMESKEGVELFVHFGIDTVELKGEGFTRIAQEGQSIKRGDTVIEFDLPLLESKAKSVLTPIVISNMDEISCIVKKSGEVVAGESVVLALKK

SEQ ID NO: 4359 - protein, 575 aa, H. influenzae strain 86-028NP
MISGILASPGIAFGKALVLKEEKIVLDTQKITDDQIDEEVARFYEGRAAAVEQLNSIRERALISLGEEKAAIFEGHLMILEDEELEEEILDYLRSNKVNAGVAASKILDQQVTMLSEIDDEYLKERAGDIRDIANRLVKNILGMHIVDLGDIQEESILVAYDLTPSETAQLNLEKVLGVVTDIGGRTSHTSIMARSLELPAIVGTNKVTKLVNTGDYLILDAINNQVYINPTASQIDELKALEAKISEEKAELAKLKDLPAITLDGHKVDIVANIGTIRDCDGAERNGAEGIGLYRTEFLFMDREQLPTEEEQFIAYKQVVEAMNGRLTVLRTMDIGGDKELSYLDLPKEMNPFLGWRAIRIALDRREILNAQLRAVLRASAFGKLAVMFPMIISVEEIRELKAVIETLKAELREEGRVFDNNIQVGVMVETPSAAVNAKFLAKEVDFFSIGTNDLTQYTLAVDRGNEFISHLYNPMHPSVLGLIKQVIDASHTEGKWTGMCGELAGDERATLLLLGMGLDEFSMSAISVPRIKKLIRNVNFQDAKALADAALQKPTAAEIDQLIEEFLLENSLN

SEQ ID NO: 4360 - protein, 85 aa, H. influenzae strain 86-028NP
MYSKDVEIIAPNGLHTRPAAQFVKEAKAFSSEITVTSGGKSASAKSLFKLQTLVLTQGTILTISADGEDEQQAVEHLVALIPTLE

SEQ ID NO: 4361 - protein, 346 aa, H. influenzae strain 86-028NP
MAKRKLTQNQTRRIQSNNAKTLHRHKKKDIEWSDEMLGESQEGVVVTRYSIHADVENEQGEIYRCNLRRTLSSLVVGDKVVWRKGNEQLQGVSGVIEAIHPRENEISRPDYYDGLKPIAANIDRIIIVSAVLPTLSLNIIDRYLVVCEIAGITPLIVLNKVDLLAQEQRQEIEDQLKIYQDIGYEILMISAKSGENMEKLTALLAQGTAIFVGQSGVGKSSLINHILPSVNAQVGDVSETSGLGQHTTTSSRLYHLPQGGNLIDSPGIREFGLWHLDAEQITKGYREFQYVLGTCKFRDCKHLSDPGCALREAVEQGKISPVRYDSYHRLIESLSETKSQRHFSLV

SEQ ID NO: 4362 - protein, 182 aa, H. influenzae strain 86-028NP
MPFDKQNLIWIDLEMTGLDPEKERIIEIATIVTDKNLNILAEGPVLAVHQSDELLNKMNDWCQKTHSENGLIERVKASKLTERAAELQTLDFLKKWVPKGASPICGNSIAQDKRFLVKYMPDLADYFHYRHLDVSTLKELAARWKPEILEGFKKENTHLALDDIRESIKELAYYREHFMKLD

SEQ ID NO: 4363 - protein, 355 aa, H. influenzae strain 86-028NP
MLSIFVTFLGAFLTLIVMRPLANWIGLVDKPNYRKRHQGTIPLIGGVSLFVGNLCYYLMEWDQLRLPYLYLFSIFVLLAIGILDDRFDISPFLRAGIQAILAILMIDLGNIYLDHLGQILGPFQLTLGSIGLIITVFATIAIINAFNMIDGIDGLLGGLSCVSFAAIGILMYRDGQMDMAHWSFALIVSILPYLMLNLGIPFGPKYKVFMGDAGSTLIGFTIIWILLLSTQGKGHPMNPVTALWIIAIPLIDMVAIIYRRVRKGKSPFRPDRLHVHHLMVRAGLTSRQAFLLITFVSAVCATIGILGEVYYVNEWAMFVGFFILFFLYVYSITHAWRITRWVRRMKRRAKRLKKA

SEQ ID NO: 4364 - protein, 863 aa, H. influenzae strain 86-028NP
MLFSPTLSSPLTPSAVKIERENLKQFELENFSRYSIFELIENRCDFYDALLIQLWQEIELSEQLGIALIAVGGYGRREMFPLSDLDFLILVEQTPSPEIEEKITQFIQFLWDCGFEVGNSVRTLEQCESEGKQDITIATNLLEARFLAGNRPHFDALNELVKRADFWSKEDFFNAKVQEQIERYQRYHNTAYNLEPDIKYSPGGLRDLHLLYWVALRHSGALTLEAILQSGFIYPQEYQQLQESRAFLFKVRFALHLILKRYDNRLLFDRQIKVSELLGFRGEGNPAVEKMMKCFFQALHRISLISNLLIQHYRENVLPSNQDTVIDQLDDDFQLINQCLCLRNSFVFQEKPARILDLFFYLTQYEHANIHSDTLRQLQISLDQLSQKLCEIPAAREKFLRLFNQPNAIKRAFMPMHQYGVLTAYLPQWQAIEGLMQFDLFHIYTVDEHTLRVMLKLESFLSQESAQEHPIAHRIFSQLSDRTLLYIAALFHDIAKGRGGDHAELGAVDIADFAQLHGLDRREIDTLAWLVKSHLLMSITAQRRDIHDPEVVMNFAEAVQNQVRLDYLTCLTVADICATNGNLWNSWKRSLFASLYEFTGRQFSQGMKELLDYSEKSAENRKLAQQILMRDYSDITPISIEQLWARCPEDYFVRNTPKQIAWHTSLLVDFVEALLVKISNRFSLGGTEVFIYCQDQPHLFNKVVSTIGAKKFSIHDAQIITTQDGYVFDSFIITELNGELVEFDRRRELEQALTLALQSEKLPALSIVPNRQLQHFTVQTDVRFLQENKKEHTQMELVALDKAGLLAQVSQIFTELNLNLLNAKITTVGEKAEDFFILTNQFGQALDSQQREILRNVLYRNIG

SEQ ID NO: 4365 - protein, 268 aa, H. influenzae strain 86-028NP
MAIPIRTEKEIVKLREACKLASDVLVMIEPYVKAGVTTGELDRICHEYMVNEQKVIPACLNYHGFPKATCISINEVVCHGIPSDDKVLKNGDIVNIDVTVIKDGYFGDNSKMYIVGGETNIRSKKLVEAAQEALYVGIRTVKPDIRLNEIGKAVQKYTESQTFSVVREYCGHGVGTEFHCEPQVLHYYADDGGVILKPGMVFTIEPMINAGKKEVRVMGDGWTVKTKDRSHSAQYEHQLVVTETGCEVMTIRDEEIAEGRISRIMVNV

SEQ ID NO: 4366 - protein, 114 aa, H. influenzae strain 86-028NP
MIDDMAVPLTFTDAAANKVKSLISEEENTNLKLRVYITGGGCSGFQYGFTFDEKVNDGDLTIEKSGVQLVIDPMSLQYLIGGTVDYTEGLEGSRFTVNNPNATSTCGCGSSFSI

SEQ ID NO: 4367 - protein, 117 aa, H. influenzae strain 86-028NP
MDFQFTHYQGNVSVKCSMEHIALANWFNTEVRSNSDKILTALSTAKSLIENQEKVLVGAEYTLFLNADEVMVRANNLAIESDEILEQDFHYYDEESLAFCGTQDFIHFLQSYVDFIA

SEQ ID NO: 4368 - protein, 781 aa, H. influenzae strain 86-028NP
MTSQHSAKKSSKNTPKNNRTFKGFLLKFSFTALVLTIFYGGYLDWQIRSKMDGQIWHLPAEVYSRLESVKIADNLAFDEVIQILLDNEYRQTTMVAAPGDFKLEDDSIVILRRAFPFPDKAEPQRVLRLRFSHNKLSRIEDLVTVKTVDEFRLAPKLIAMLQSDNEDRLAIPLQNYPRLLIDTLILTEDRRFYEHNGINPVGILRALIANIRAGQTVQGGSTLTQQLVKNLFLSRERTITRKANEALMSLVLDWRYDKNRILETYLNEIYLGQNGDTQIHGFELASQFYFGRSIREISLDQIALLVGMVKGPSLYNPWRNPQNALERRNIVLRLMLEHKMIGDELYQLLSQRPLGVQKKGQISRKYPAFIQTLQADLRRELGEHKISSLLGARIFSTMDLKQQAQAENAVVNTVSQLQLKMKNPHLEGAMIITDYRTGEIRAVVGGLQTQYAGFNRALMAKRQIGSLVKPSIYLTALSNPEQFRLNTPINNQPITINVKGSPPWQPRNYDKKYSDSVMLMDALARSLNIPTVNIGMKVGLSKVIDTQKAMGWDNVEIPKVPAMLLGSYSISPYDVTKLYQTLANQGGRIALTTVDSIADRQGNLIFQHDKSAKQVVPQEAAFQTLFAMQQTVERGTARSLQKDYADLHLAGKTGTTNESRDTWFVGIDGKNISTVWLGRDDNGETKLTGASGALQIYKDYLNRTNIEKLAITPPTTVKWVGINQYGDWDCESYRTIPVWLNNGQNFCGETSSPSLTPTTETETPPQESLWDVLDNPNPPAQ

SEQ ID NO: 4369 - protein, 306 aa, H. influenzae strain 86-028NP
VRYNTHQFLLSYRCKTMTQQLPILSLKKIYSGKVRDLYEIDDKRMLMVASDRLSAFDVILDDPIPRKGEILTQISNFWFNKLAHIMPNHFTGDSVYDVLPKEEADLIRNRTVVCKRLNPIKIESIVRGYLTGSGLKDYKQTGTICGLKLPEGLVEASKLPEAIFTPSSKEEVGNHDINISYAECEKLIGADLAAQVKEKAIALYTVAAEYALTKGIIICDTKFEFGLDENGTLTLMDEVLTPDSSRFWSVDTYQAGTNPPSFDKQFVRDWLENSGWNKQAPAPKVPENIIQKTVDKYQEALDLLTK

SEQ ID NO: 4370 - protein, 444 aa, H. influenzae strain 86-028NP
MSNTILQNLPKGQKVGIAFSGGLDTSAALLWMRQKGAVPYAYTANLGQPDEDDYNAIPKKAMAYGAENARLIDCRSQLAHEGIAAIQCGAFHISTGGIPYFNTTPLGRAVTGTMLVAAMKEDDVNIWGDGSTFKGNDIERFYRYGLLTNPNLKIYKPWLDVQFIEELGGRLEMSQFLIENGFDYKMSVEKAYSTDSNMLGATHEAKDLEQLSTGMKIVKPIMGVAFWDEKVEIKPETVTVTFEDGVPVALNGKHFDNAVDLILEANRIGGRHGLGMSDQIENRIIEAKSRGIYEAPGMALLHIAYERLVTGIHNEDTIEQYRINGIRLGRLLYQGRWFDPQALMLRETAQRWVAKAITGTVTLELRRGNDFTILNTESPNLTYEAERLSMEKVEDAPFDPVDRIGQLTMRNLDVSDTRGKLGIYAQTGLLSAIKDSVLPQLGKK

SEQ ID NO: 4371 - protein, 397 aa, H. influenzae strain 86-028NP
MASITHRRNAVLGAAFLMATSAIGPGFLTQTATFTNTLLASFGFVILLSILLDIGAQLNIWRIVIVSGKRAQDISNAVFPKAGYFLAALIVMGGLAFNIGNVGGAGLGLNSIFGIAPEMGAVISGIIAILIFLRKEAGLLMDRFAQLMGFIMVALTFYVMFKTEPPVAEAAYHSFIPEKIDPIAIVTLVGGTVGGYITFAGAHRLLDAGIQGEKAMAEVSRSSVSAILIASTMRVVLFLAVLGVVSKGVSLNPKNPAETPFEYVAGNFGQVLFGVVIWAASVTSVIGAAYTSVSFLTTLCPTIERNRNRWIIAFIVISTVVLVTVGKPAAVLVFVGTLNGLILPIALALILLAAYRSDIVGTYKHPVFLAFSGWFVVIIMAILSGKTIISYISSFFS

SEQ ID NO: 4372 - protein, 245 aa, H. influenzae strain 86-028NP
MKKIDLNADIAEGFPFDESLLQLLSSANIACGLHAGGAKEMQSAVKFAKENKVRIGAHPSFPDRENFGRTAMALSSQELIAHLRYQLGALKAICDGEGAVISYVKPHGALYNQAAKDEKIARVIAQTVYQFDPNLKLMGLAGSLMLRIAEEEKLQTISEVFADRHYMPDGSLVPRSQPNAMVESDKEAIQQVLQMVTKGQVNAIDGSLVPVKAESICLHGDNQHSLQFAKRIVEELEKNHIKITA

SEQ ID NO: 4373 - protein, 309 aa, H. influenzae strain 86-028NP
MIDILDVKSRATIQDLGRFGLRRFGISHCGAMDKLALRAGNILLGNAENVPAIEVPLGGITLQFQQDMNFCVTGAFYEMMLDDKPVFAYWRYQVRAGQILKMTRAKIGMYGYLCVQGGFVLPQALNSCSTDLRAEIGGIEGRCLQAGDQLQTANDHILRSEIGIAPIPLRDVIRALPSSEYQAFKRKSQYYWWRNEWTLQSNSDRMGYRFQGQTLELKQPLEMLSHAIQFGSVQVPPSGQPIILMADAQTTGGYPKIANVIDADLGALAQVRLGSTIKFEAVSLQEAAKLRRKNEIYLDQIRRIVDEKN

SEQ ID NO: 4374 - protein, 213 aa, H. influenzae strain 86-028NP
MNIVPISESAVVCSLPPPASIQQQRQLWAFARQLQSEQDIVEVVLGMNNLTVFTDFFVDFKPLVQRLEQLWAELKVSDFQGRHIEIPVIYGGERGQDLSDVAKFHQTTPKRIIQMHSEPIYTVYMIGFQAGFPYLGGLPENLHTPRRATPRTVVPAGSVGIGGAQTGIYPFSSPGGWQLIGYTKQALFDKNQAQPTLLQAGDTVKFIVDGIEL

SEQ ID NO: 4375 - protein, 659 aa, H. influenzae strain 86-028NP
MFQDNPLLAQLKQQIHDSKEQVEGVVKSTDKAYGFLECDKKTYFIAPPSMKKVMHGDKIKATIEKQGDKEQAEPEALIEPMLTRFIAKVRFNKDKKLQVLVDHPSINQPIGAQQAKSVKEELQEGDWVVANLKTHPLRDDRFFYATINQFICRADDELAPWWVTLARHEQSRYPVQGAEHYEMLDQKTRENLTALHFVTIDSESTMDMDDALYIEPIAQNSTQTGWKLVVAIADPTAYIALDSQIEQEAKQRCFTNYLPGFNIPMLPRELSDELCSLIANETRPALVCYIETDLAGNITAKPHFVSAYVQSKAKLAYNKVSDYLEQADNAWQPETPETAQQIHWLHQFTKARIQWHKTHSLLFKEKPDYAFVLAENGKVQEIKAEYRRIANQIVEEAMIIANICAAQFLHEQAKTGIFNTHSGFDKKFLENAHHFLMANLANEQNQTELAERYSVENLATLNGYCQMRHDIEPIESDYLELRLRRYLTFAEFKSELAPHFGLGLEGYATWTSPIRKYSDMVNHRLIKAVLAKQPYEKTQNDVLARLQEARRQNRLVERDIADWLYCRYLAPKVAENVEFNAEVQDVMRGGLRVQLLENGASMFIPASTLHNNKEEMQVNSDEIALYIKGERTYKIGDIVKVKLTEVKEATRSIVGEILQ

SEQ ID NO: 4376 - protein, 295 aa, H. influenzae strain 86-028NP
VRLVFLEILVCFVQRQIFAYTTQVFYANNIGKIMGFLTGKRILVTGLASNRSIAYGIAKSMKEQGAELAFTYLNDKLQPRVEEFAKEFGSDIVLPLDVATDESIQNCFAELSKRWDKFDGFIHAIAFAPGDQLDGDYVNAATREGYRIAHDISAYSFVAMAQAARPYLNPNAALLTLSYLGAERAIPNYNVMCLAKASLEAATRVMAADLGKEGIRVNAISAGPIRTLAASGIKNFKKMLSTFEKTAALRRTVTIEDVGNSAAFLCSDLASGITGEIVHVDAGFSITAMGELGEE

SEQ ID NO: 4377 - protein, 527 aa, H. influenzae strain 86-028NP
MSYPLEEVNKRRTFAIISHPDAGKTTITEKVLLYGNAIQTAGSVKGKGSAAHAKSDWMEMEKQRGISITTSVMQFPYNNCLVNLLDTPGHEDFSEDTYRTLTAVDSCLMVIDSAKGVEERTIKLMEVTRLRDTPIITFMNKLDRDIRDPMELLDEVENVLKIRCAPITWPIGCGKLFKGVYHLAKDETYLYQSGQGSTIQAVRVVKGLNNPELDVAVGDDLAQQLRDELELVQGASNEFEQDAFIKGELTPVFFGTALGNFGVDHFLDGLTQWAPKPQSRQADTRTVESAEEKFSGFVFKIQANMDPKHRDRVAFMRVVSGKYEKGMKLKHVRIGKDVVISDALTFMAGDRAHAEEAYAGDIIGLHNHGTIQIGDTFTQGETLKFTGIPNFAPELFRRIRLKDPLKQKQLLKGLVQLSEEGAVQVFRPLLNNDLIVGAVGVLQFDVVVSRLKTEYNVEAIYENVNVATARWVECADGKKFEEFKRKNEQNLALDGGDNLTYIAPTMVNLNLAQERYPDVVFYKTREH

SEQ ID NO: 4378 - protein, 77 aa, H. influenzae strain 86-028NP
MDFNFIEFLGYMATFFVAVSFLFKSIVYLRIVNSIGAILFVIYSVIITAYPVALLNAFLVVVNIYQLWRLKQENLSK

SEQ ID NO: 4379 - protein, 109 aa, H. influenzae strain 86-028NP
MTLTEQIITIGICIVAVQFTRLLPFFVFPVNRPIPQYIRYLGKVLPPAMFGMLVVYCYKNIEILTGYHGIPDLLAGIVVLGLHFWKKNMFLSIAVGTLFYMALVQLIFI

SEQ ID NO: 4380 - protein, 244 aa, H. influenzae strain 86-028NP
MNLSQQNQHSNPITEAAKAAFPYSVPMIAGFLFLGIAYGIYMKALGFGFLYPTLMALLIYAGSVEFIAAGALIAPFSPISVLLITLMISARQIFYGISMLEKYGIHIGKKRWYLITTLVDESFSLNYMAKIPQHLDKGWYMFFVSLYLHIYWVLGAAMGNLFGTVLPFNLKGVEFSMTALFLVIFAENWLKEKSHESSLLGLGIAFAFLLIIGKEYFLIPTLIGIWLILTMRITKLETKLESLK

SEQ ID NO: 4381 - protein, 309 aa, H. influenzae strain 86-028NP
MKPTFLEFRHLKTLLALKETGSVSLAAKHVYLTQSALSHQIKLIEEQFGLPLFERKSNPLRFTSAGERLIRLANEVMPKVIDAERDLARVKHGDAGQLRIAVECHTCFDWLMPAMDEFRQHWGLVELDIVSGFHTDPVGLLLSHRADWAIVSEIEHNDDVIFKPLFSYEMVGICSKNHSLAEKDIWEAEDFIDETWVTYPVPDDMLDLWRKVLKSKGINPTRRTTELTIAMIQLVASRRGIATIPYWAALPYLEKGYVVARKVTKEGLYSNLYAAIRKEDESLSYLEDFYQTVKSQSFSTLPGLSVLNL

SEQ ID NO: 4382 - protein, 381 aa, H. influenzae strain 86-028NP
MIISSASDYREAARRRVPPFMFHYADGGSYAEQTLARNVSDLENIALRQRVLKDMSELDTSIELFGEKLSMPTILAPVGACGMYARRGEVQAAQAADNKGVPFTLSTVSICPIEEVAPAIKRPMWFQLYVLKDRGFMKNALERAKAAGCSTLVFTVDMPTPGARYRDMHSGMSGPYKEIRRVLQGFTHPFWAYDVGIKGKPHTLGNVSTYMGRQIGLDDYIGWLTENFDPSISWKDLEWIREFWEGPMVIKGILDPEDAKDAVRFGADGIVVSNHGGRQLDGVLSSARALPPIADAVKGDIKIIADSGIRNGLDIVRMLALGADATMLGRAFVYALGAAGRQGVENMLDIFKKEMRVAMTLTSNRTIVDIKPEALVDLSKL

SEQ ID NO: 4383 - protein, 269 aa, H. influenzae strain 86-028NP
MDKKEKRPTVLFFDSGVGGFSVYREAKKLLPNWHYLYCFDNAGFPYSEREEESIIHRTLAACQLINQRYPLDAIVIACNTASTVVLPPLRAAFEIPIIGTVPAIKPASEITKTKHIGLLATKGTVKRHYIDELIDKFAQDCIVERLGTTKLVEIAEQKIRGHSVDLISLKDELSSWAGMADLDTLVLGCTHFPLIKDEIQLCLPQVKYFMDPSAAIAKRIKYLLDDKNLQVQNEKYNQMFCTAHFPEESQFKKALHLWGFESLEVIKID

SEQ ID NO: 4384 - protein, 693 aa, H. influenzae strain 86-028NP
MSLELLDAVPLTSLSGVGAAISNKLAKIGIQNLQDLLFHLPIRYEDRTRITPIANLRPEQYFTIEGIVQTCEVAFGRRPILSVSLSDGTSKIMLRFFNFNAGMRNSFQAGVRVKAFGEVKRGRHMPEIHHPEYQIVRDNAPIVLEETLTPIYSTTEGLKQNSLRKLTDQALTLLDKVQIAEILPNEFNPHQYSLKEALRLLHRPPPDISLEMLEQGKHPAQQRLIFEELLAHNLAMQKVRLGTQQFSALPLHYQTDLKQRFLATLPFQPTNAQKRVVSDIEQDLIKDYPMMRLVQGDVGSGKTLVAALAALTAIDNGKQVALMAPTEILAEQHANNFRRWFEPFGIEVGWLAGKVKGKSRQAELEKIKTGAVQMVVGTHALFQEEVEFSDLALVIIDEQHRFGVHQRLMLREKGEKAGFHPHQLIMTATPIPRTLAMTVYADLDTSIIDELPPGRTPITTVVVSEERRAEIVMRVKNACVNEKRQAYWVCTLIDESEVLEAQAAEAIWEDLTKALPMLNIGLVHGRMKPQEKQDVMMRFKNAELDLLVATTVIEVGVDVPNASLMIIENAERLGLSQLHQLRGRVGRGSTASFCVLMYKPPLGKVSQKRLQVLRDSQDGFVISEKDLEIRGPGEVLGTKQTGIAELRIANLMRDRKMIPTVQHYAKSLIQKYPDVAESLICRWLNNKEIYSNA

SEQ ID NO: 4385 - protein, 704 aa, H. influenzae strain 86-028NP
LELFADLDRIIQGYLPADKIELIKRAFVIARDAHEGQFRSSGEPYITHPVAVASIIAQLHLDHEAVMAALLHDVIEDTPYTENQLKEEFGASVAEIVDGVSKLDKLKFRTRQEAQVENFRKMILAMTRDIRVVLIKLADRTHNMRTLGSLRPDKRRRIAKETLEIYCPLAHRLGIEHIKNELEDLSFQAMHPHRYEVLKKLVDVARSNRQDLIERISQEIKVRLENAGIFARVWGREKHLYKIYQKMRIKDQEFHSIMDIYAFRVIVKNVDDCYRILGQMHNLYKPRPGRVKDYIAVPKANGYQSLQTSMIGPKGVPVEVHIHTEDMEQVAEMGITAHWVYKENGKNDSTTAQIRVQRWLQSLVEIQQSVGNSFEFIENVKSEFFPKEIYVFTPKGRIVELPMGATAVDFAYAVHSDVGNTCVGVTVEHKPYPLSKALESGQTVNIITDPNAHPEVAWLNFVVTARAKTRIRHYLKQRCEEDAVKLGEVELNVALQPHNLGDFSIQQISTVLDALALSSLDELLREIGLGNQSASMIAHQFVGVPLESANTKNLEFESKILTIAPMQVGKTQFAQCCHPILGDPIVGCCTEKNTVVVHHQHCASLKNACRQSLAKWDNVQSAVNFEAELQIEILNEQNALLSLMTAISASESSLQNIWTEELENNLLLVILQVCVKDIKHLANIVHRIKGITGVVNVKRNINEL

SEQ ID NO: 4386 - protein, 88 aa, H. influenzae strain 86-028NP
MARVTVQDAVEKIGNRFDLILTAARRARQLQLNQSAPLVPEDNDKPTVIALREIEKGLINQDIMDAQEFQKMAKVQETEEAAVALITE

SEQ ID NO: 4387 - protein, 208 aa, H. influenzae strain 86-028NP
MSQGNLYILSAPSGAGKSSLISALLASDSSTQKMVSVSHTTRAPRPGEVEGVHYYFVSKEEFESLIEQDLFLEYAKVFGGNYYGTSLPAIEENLAKGIDVFLDIDWQGAQQIRKKVPSVKSIFILPPSLPELERRLIGRGQDSEEVIAERMSKAISEISHYDEYDYVIVNDDFEKTLKDLQSILQSERLTKDYQQKQNAMLIQQLLAK
